United States Patent
Bettencourt et al.

(10) Patent No.: US 9,228,188 B2
(45) Date of Patent: Jan. 5, 2016

(54) COMPOSITIONS AND METHOD FOR INHIBITING HEPCIDIN ANTIMICROBIAL PEPTIDE (HAMP) OR HAMP-RELATED GENE EXPRESSION

(75) Inventors: Brian Bettencourt, Groton, MA (US); Akin Akinc, Needham, MA (US); Alfica Sehgal, Allston, MA (US); Don Foster, Attleboro, MA (US); Stuart Milstein, Cambridge, MA (US); Satyanarayana Kuchimanchi, Acton, MA (US); Martin A. Maier, Belmont, MA (US); Klaus Charisse, Acton, MA (US); Kallanthottathil Rajeev, Wayland, MA (US)

(73) Assignee: ALNYLAM PHARMACEUTICALS, INC., Cambridge, MA (US)

(*) Notice: Subject to any disclaimer, the term of this patent is extended or adjusted under 35 U.S.C. 154(b) by 0 days.

(21) Appl. No.: 14/118,489

(22) PCT Filed: Jun. 21, 2012

(86) PCT No.: PCT/US2012/043603
§ 371 (c)(1),
(2), (4) Date: Nov. 18, 2013

(87) PCT Pub. No.: WO2012/177921
PCT Pub. Date: Dec. 27, 2012

(65) Prior Publication Data
US 2014/0127325 A1  May 8, 2014

Related U.S. Application Data

(60) Provisional application No. 61/499,516, filed on Jun. 21, 2011, provisional application No. 61/569,054, filed on Dec. 9, 2011.

(51) Int. Cl.
*C12N 15/11* (2006.01)
*C12N 15/113* (2010.01)
*A61K 31/7105* (2006.01)
*A61K 33/26* (2006.01)
*A61K 47/48* (2006.01)

(52) U.S. Cl.
CPC .......... *C12N 15/113* (2013.01); *A61K 31/7105* (2013.01); *A61K 33/26* (2013.01); *A61K 47/48092* (2013.01); *C12N 15/1136* (2013.01); *C12N 15/1138* (2013.01); *C12N 2310/14* (2013.01); *C12N 2310/315* (2013.01); *C12N 2310/321* (2013.01); *C12N 2310/322* (2013.01); *C12N 2310/3521* (2013.01); *C12N 2310/3533* (2013.01); *C12N 2320/30* (2013.01)

(58) Field of Classification Search
None
See application file for complete search history.

(56) References Cited

U.S. PATENT DOCUMENTS

| | | | |
|---|---|---|---|
| 6,054,299 A | 4/2000 | Conrad | |
| 7,374,927 B2 | 5/2008 | Palma et al. | |
| 7,427,605 B2 | 9/2008 | Davis et al. | |
| 7,718,629 B2 | 5/2010 | Bumcrot et al. | |
| 8,163,711 B2 | 4/2012 | Nakayama et al. | |
| 8,268,799 B2 | 9/2012 | Nakayama et al. | |
| 8,470,799 B2 | 6/2013 | Nakayama et al. | |
| 8,791,250 B2 | 7/2014 | Nakayama et al. | |
| 2003/0143732 A1 | 7/2003 | Fosnaugh et al. | |
| 2003/0170891 A1 | 9/2003 | McSwiggen | |
| 2004/0259247 A1 | 12/2004 | Tuschl et al. | |
| 2005/0004026 A1* | 1/2005 | Kasibhatla et al. | 514/12 |
| 2005/0272080 A1 | 12/2005 | Palma et al. | |
| 2006/0263435 A1 | 11/2006 | Davis et al. | |
| 2007/0004664 A1 | 1/2007 | McSwiggen et al. | |
| 2007/0031844 A1* | 2/2007 | Khvorova et al. | 435/6 |
| 2007/0224186 A1 | 9/2007 | Kulaksiz et al. | |
| 2007/0281899 A1 | 12/2007 | Bumcrot et al. | |
| 2008/0213277 A1 | 9/2008 | Sasu et al. | |
| 2009/0149403 A1 | 6/2009 | MacLachlan | |
| 2009/0209478 A1 | 8/2009 | Nakayama et al. | |
| 2010/0204307 A1 | 8/2010 | Nakayama et al. | |
| 2011/0015250 A1 | 1/2011 | Bumcrot et al. | |
| 2012/0244207 A1 | 9/2012 | Fitzgerald et al. | |
| 2014/0294936 A1 | 10/2014 | Nakayama et al. | |

FOREIGN PATENT DOCUMENTS

| | | |
|---|---|---|
| DE | 10100586 | 4/2002 |
| JP | 2001149083 | 6/2001 |
| WO | WO 99/32619 | 7/1999 |
| WO | WO 99/53050 | 10/1999 |
| WO | WO 99/61631 | 12/1999 |
| WO | WO 00/22113 | 4/2000 |
| WO | WO 00/22114 | 4/2000 |
| WO | WO 00/44895 | 8/2000 |
| WO | WO 02/098444 | 12/2002 |
| WO | WO 2004/080406 | 9/2004 |

(Continued)

OTHER PUBLICATIONS

PCT International Search Report and Written Opinion for PCT/US2012/043603, Dec. 7, 2012, 14 Pages.

(Continued)

*Primary Examiner* — Tracy Vivlemore
*Assistant Examiner* — Kate Poliakova
(74) *Attorney, Agent, or Firm* — Fenwick & West LLP

(57) ABSTRACT

The invention relates to lipid formulated double-stranded ribonucleic acid (dsRNA) targeting a hepcidin antimicrobial peptide (HAMP) and/or HAMP-related gene, and methods of using the dsRNA to inhibit expression of HAMP and/or HAMP-related genes.

22 Claims, 10 Drawing Sheets

(56) References Cited

FOREIGN PATENT DOCUMENTS

| WO | WO 2004/090108 | 10/2004 |
|---|---|---|
| WO | WO 2007/120883 | 10/2007 |
| WO | WO 2007/120883 A2 | 10/2007 |
| WO | WO 2008/036933 A2 | 3/2008 |
| WO | WO 2008/089795 | 7/2008 |
| WO | WO 2009/073809 A2 | 6/2009 |
| WO | WO 2010/147992 | 12/2010 |

OTHER PUBLICATIONS

Agrawal, S., et al., "Antisense oligonucleotides: towards clinical trials." Trends in Biotechnology. Oct. 1996, vol. 14, pp. 376-387.
Andrews, N. C., "Anemia of Inflammation: the Cytokine-Hepcidin Link," J. Clin. Invest., vol. 113, No. 9, May 1, 2004.
Bass, B., "The short answer," Nature, May 24, 2001, pp. 428-429, vol. 411.
Boese et al., "Mechanistic Insights Aid Computational Short Interfering RNA Design," Methods in Enzymology, vol. 392, pp. 73-96, 2005.
Couture, A., et al., "Anti-Gene Therapy: The Use of Ribozymes to Inhibit Gene Function," TIG, vol. 12, No. 12, pp. 510-515, Dec. 1996.
Crosby, J., et al., "Targeting Hepcidin with Antisense Oligonucleotides Improves Anemia Endpoints in Mice," Antisense Drug Discovery, Abstract No. 269, American Society of Hematology Annual Meeting, Nov. 16, 2006, vol. 108, No. 11, pp. 83a-84a.
Donovan, A., et al., "Positional Cloning of Zebrafish ferroporin 1 Identifies a Conserved Vertebrate Iron Exporter," Nature, vol. 403, pp. 776-781, Feb. 2000.
Elbashir, S., et al., "Analysis of gene function in somatic mammalian cells using small interfering RNAs," Methods, 2002, pp. 199-213, vol. 26.
Elbashir, S., et al., "Duplexes of 21-nucleotide RNAs mediate RNA interference in mammalian cell culture," Nature, May 24, 2001, p. 494-498, vol. 411.
Elbashir, S., et al., "Functional Anatomy of siRNAs for Mediating Efficient RNAi in *Drosophila melanogaster* Embryo Lysate", The EMBO Journal, 2001, pp. 6877-6888, vol. 20, No. 23.
Elbashir, S., et al., "RNA Interference is Mediated by 21- and 22 Nucleotide RNAs," Genes & Development, 2001, pp. 188-200, vol. 15.
Fire, A., "RNA-triggered Gene Silencing," Trends in Genetics, Sep. 1999, pp. 358-363, vol. 15, No. 9.
Fire, A., et al., "Potent and Specific Genetic Interference by Double Stranded RNA in Caenorhabditis elegans," Nature, Feb. 19, 1998, pp. 806-811, vol. 391.
Fleming, R.E., et al., "Hepcidin: A Putative Iron-Regulatory Hormone Relevant to Hereditary Hemochromatosis and the Anemia of Chronic Disease," Proceedings of the National Academy of Science, vol. 98, No. 15, pp. 8160-8162, 2001.
Fleming, R.E., "Advances in Understanding the Molecular Basis for the Regulation of Dietary Iron Absorption," Curr. Opin. Gastrolenterol, vol. 21, pp. 201-206, 2005.
Ganz, T., "Hepcidin, a Key Regulator of Iron Metabolism and Mediator of Anemia of Inflammation," Blood, vol. 102, No. 3, pp. 783-788, Aug. 2003.
Gassmann, M., et al., "Maintenance of an Extrachromosomal Plasmid Vector in Mouse Embryonic Stem Cells," Proc. Nat'l. Acad. Sci., USA, vol. 92, pp. 1292-1296, 1995.
Genbank Accession No. NM_021175.2, Feb. 19, 2006.
GenBank Accession No. NM_032541.1 (Oct. 22, 2011), NCBI Sequence Viewer, [online] [Retrieved on Nov. 18, 2011] Retrieved from the internet <http://www.ncbi.nlm.nih.gov/nuccore/NM.sub.--032541.1>.
Holen et al., "Positional Effects of Short Interfering RNAs Targeting the Human Coagulation Trigger Tissue Factor," Nucleic Acid Research, vol. 30, pp. 1757-1766, 2002.
Hornung, V., et al., "Sequence-specific potent induction of IFN-α by short interfering RNA in plasmacytoid dendritic cells through TLR7," Nature Medicine, Mar. 2005, pp. 263-270, vol. 11, No. 3.
Li, S., et al., "Folate-Mediated Targeting of Antisense Oligodeoxynucleotides to Ovarian Cancer Cells," Pharm. Res., vol. 15, No. 10, pp. 1540-1545, 1998.
Manoraran, M., "Oligonucleotide Conjugates as Potential Antisense Drugs with Improved Uptake, Biodistribution, Targeted Delivery, and Mechanism of Action," Antisense & Nucleic Acid Drug Development, vol. 12, pp. 103-128, 2002.
Nemeth, E., et al., "Hepcidin Regulates Cellular Iron Efflux by Binding to Ferroportin and Inducing its Internalization," Science, vol. 306, pp. 2090-2093, 2004.
Nicholas et al., "Lack of Hepcidin Gene Expression and Severe Tissue Iron Overload in Upstream Stimulatory Factor 2 (USF2) Knockout Mice," Proceedings of the National Academy of Science, vol. 98, vol. 15, pp. 8780-8785, 2001.
Nicholas, G., et al., "The Gene Encoding the Iron Regulatory Peptide Hepcidin is Regulated by Anemia, Hypoxia and Inflammation," The J. of Clin. Invest., vol. 110, No. 7, pp. 1037-1044, Oct. 2002.
Office Action for Australian Patent Application No. 2007299629, mailed Mar. 8, 2011, 2 pages.
Office Action for Canadian Patent Application No. 2,663,581, mailed May 14, 2012, 2 pages.
Office Action for Canadian Patent Application No. 2,663,581, mailed Jan. 18, 2011, 4 pages.
Papanikolaou, G., et al., "Hepcidin in Iron Overload Disorders," Blood, vol. 105, pp. 4103-4105, 2005.
Park, C.H., et al., "Hepcidin, a Urinary Antimicrobial Peptide Synthesized in the Liver," J. Biol. Chem., vol. 276, pp. 7806-7810, 2001.
Patent Examination Report No. 1 for Australian Patent Application No. AU 2011250816, Dec. 21, 2012, 2 Pages.
PCT International Search Report and Written Opinion, PCT/US2007/079212, Aug. 14, 2008, 11 pages.
Pietrangelo, A., "Hereditary Hemochromatosis—A New Look at an Old Disease," New England Journal of Medicine, Jun. 3, 2004, pp. 2383-2397, vol. 350, No. 23.
Pigeon, C., et al., "A New Mouse Liver-Specific Gene, Encoding a Protein Homologous to Human Antimicrobial Peptide Hepcidin, is Overexpressed During Iron Overload," J. Biol. Chem., vol. 276, pp. 7811-7819, 2001.
Reynolds, et al. (2004) "Rational siRNA design for RNA interference," Nature Biotechnology, vol. 22, No. 3, pp. 326-330.
Robbins, M., et al., "Stable expression of shRNAs in human CD34+ progenitor cells can avoid induction of interferon responses to siRNAs in vitro," Nature Biotechnology, May 2006, pp. 566-571, vol. 24, No. 5.
Roetto, A., et al., "Mutant Antimicrobial Peptide Hepcidin Is Associated With Severe Juvenile Hemochromatosis," Nature Genetics, Jan. 2003, pp. 21-22, vol. 33.
Rose, S., et al., "Functional polarity is introduced by Dicer processing of short substrate RNAs," Nucleic Acids Research, 2005, pp. 4140-4156, vol. 33, No. 13.
Schwarz et al., "Asymmetry in the Assembly of the RNAi Enzyme Complex," Cell, vol. 115, pp. 199-208, 2003.
Supplementary European Search Report, European Patent Application No. EP 07853594, Nov. 5, 2010, 7 Pages.
Tuschl, T., "Functional genomics: RNA sets the standard," Nature, Jan. 16, 2003, vol. 421, No. 6920, pp. 220-221.
Tuschl T., "RNA Interference and Small Interfering RNAs" Chembiochem, 2001, pp. 239-245, vol. 2.
Tuschl, T., et al., "Small Interfering RNAs: A Revolutionary Tool for the Analysis of Gene Function and Gene Therapy," Molecular Interventions, 2002, pp. 158-167, vol. 2, No. 3.
Tuschl, T., "Mammalian RNA Interference," RNAi, A Guide to Gene Silencing, Chapter 13, G.J. Hannon (ed,), 2003, pp. 265-295.
Tuschl, T., et al., "Targeted mRNA Degradation by Double-Stranded RNA In Vitro," Genes & Development, 1999, pp. 3191-3197, vol. 13.
Tuschl, T., "Expanding small RNA interference," Nature Biotechnology, May 2002, pp. 446-448, vol. 20.
Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.

(56) References Cited

OTHER PUBLICATIONS

Weil, et al (2002) "Targeting the Kinesin Eg5 to Monitor siRNA Transfection in Mammalian Cells," *Biotechniques* 33(6):1244-1248.
Weiss, G., et al., "Anemia of Chronic Disease," N. E. J. of Med., vol. 352, pp. 1011-1023, 2005.
Yang, D., et al., "Evidence that processed small dsRNAs may mediate sequence-specific mRNA degradation during RNAi in *Drosophila* embryos," Curr. Biol., vol. 10, No. 19, pp. 1191-1200, 2000.
Zimmerman, et al. (2006) "RNAi-mediated gene silencing in non-human primates," *Nature*, vol. 441, May 4: 111-114.
European Extended Search Report, European Application No. 12801896.7, Nov. 11, 2014, 7 pages.
Ganz, T. et al., "Hepcidin and Disorders of Iron Metabolism," Annual Review of Medicine, Feb. 18, 2011, pp. 347-360, vol. 62, No. 1.
Theurl, I. et al., "Autocrine Formation of Hepcidin Induces Iron Retention in Human Monocytes," Blood, Dec. 11, 2007, pp. 2392-2399, vol. 111, No. 4.
Bartolomei, G. et al., "Modulation of Hepatitis C Virus Replication by Iron and Hepcidin in Huh7 Hepatocytes," Journal of General Virology, May 18, 2011, pp. 2072-2081, vol. 92, No. 9.
United States Office Action, U.S. Appl. No. 14/303,921, Oct. 6, 2014, 13 pages.
United States Office Action, U.S. Appl. No. 13/900,854, Sep. 24, 2013, 11 pages.
United States Office Action, U.S. Appl. No. 13/590,783, Oct. 15, 2012, 11 pages.
United States Office Action, U.S. Appl. No. 13/184,087, Jan. 10, 2012, 14 pages.
United States Office Action, U.S. Appl. No. 12/757,497, May 6, 2011, 9 pages.
United States Office Action, U.S. Appl. No. 11/859,288, Dec. 21, 2009, 12 pages.
Office Action for Canadian Patent Application No. 2,663,581, mailed Apr. 23, 2013, 2 pages.
European Examination Report, European Application No. 07853594.5, Mar. 13, 2014, 4 pages.

* cited by examiner

US 9,228,188 B2

COMPOSITIONS AND METHOD FOR INHIBITING HEPCIDIN ANTIMICROBIAL PEPTIDE (HAMP) OR HAMP-RELATED GENE EXPRESSION

CROSS REFERENCE TO RELATED APPLICATIONS

This application claims the benefit of U.S. Provisional Application Ser. No. 61/499,516, filed Jun. 21, 2011, and claims the benefit of U.S. Provisional Application Ser. No. 61/569,054, filed Dec. 9, 2011; each of which are incorporated herein by reference, in their entirety, for all purposes.

REFERENCE TO SEQUENCE LISTING

This application includes a Sequence Listing submitted electronically as a text file named 20072PCT_CRF_.txt, created on Jul. 17, 2012, with a size of 519,357 bytes. The sequence listing is incorporated by reference.

FIELD

The disclosure relates to double-stranded ribonucleic acid (dsRNA) targeting HAMP, HFE2, HFE, TFR2, BMPR1a, SMAD4, IL6R, BMP6, and/or NEO1, and methods of using dsRNA to inhibit expression of HAMP, HFE2, HFE, TFR2, BMPR1a, SMAD4, IL6R, BMP6, and/or NEO1.

BACKGROUND

The discovery of the hepcidin peptide and characterization of its gene, HAMP, has led to the revision of previous models for the regulation of iron homeostasis and the realization that the liver plays a key role in determining iron absorption from the gut and iron release from recycling and storage sites. In summary, the hepcidin model proposes that the rate of iron efflux into the plasma depends primarily on the plasma level of hepcidin; when iron levels are high the synthesis of hepcidin increases and the release of iron from enterocytes and macrophages is diminished. Conversely when iron stores drop, the synthesis of hepcidin is down-regulated and these cells release more iron. Hepcidin directly binds to ferroportin and decreases its functional activity by causing it to be internalized from the cell surface and degraded.

Hepcidin provides a unifying hypothesis to explain the behavior of iron in two diverse but common clinical conditions, the anemia of chronic disease and both HFE and non-HFE haemochromatosis. The pathophysiology of hepcidin has been sufficiently elucidated to offer promise of therapeutic intervention in both of these situations. Administering either hepcidin or an agonist could treat haemochromatosis, where the secretion of hepcidin is abnormally low.

The anemia of inflammation, commonly observed in patients with chronic infections, malignancy, trauma, and inflammatory disorders, is a well-known clinical entity. Until recently, little was understood about its pathogenesis. It now appears that the inflammatory cytokine IL-6 induces production of hepcidin, an iron-regulatory hormone that may be responsible for most or all of the features of this disorder. (Andrews N C. *J Clin Invest.* 2004 May 1; 113(9): 1251-1253). As such, down regulation of hepcidin in anemic patients will lead to a reduction in inflammation associated with such anemia.

Double-stranded RNA molecules (dsRNA) have been shown to block gene expression in a highly conserved regulatory mechanism known as RNA interference (RNAi). WO 99/32619 (Fire et al.) discloses the use of a dsRNA of at least 25 nucleotides in length to inhibit the expression of genes in *C. elegans*. dsRNA has also been shown to degrade target RNA in other organisms, including plants (see, e.g., WO 99/53050, Waterhouse et al.; and WO 99/61631, Heifetz et al.), *Drosophila* (see, e.g., Yang, D., et al., *Curr. Biol.* (2000) 10:1191-1200), and mammals (see WO 00/44895, Limmer; and DE 101 00 586.5, Kreutzer et al.). This natural mechanism has now become the focus for the development of a new class of pharmaceutical agents for treating disorders that are caused by the aberrant or unwanted regulation of a gene.

The following publications disclose dsRNA (siRNA) targeting the HAMP gene and are herein incorporated by reference for all purposes: WO 2008/036933 (International application no. PCT/US2007/079212, filed Sep. 21, 2007); US 2009-0209478 (U.S. patent application Ser. No. 11/859,288, filed Sep. 21, 2007); US 2010-0204307 (U.S. patent application Ser. No. 12/757,497, filed Apr. 9, 2010); US 2011-0269823 (U.S. patent application Ser. No. 13/184,087, filed Jul. 15, 2011).

DESCRIPTION OF THE DRAWINGS

FIG. 5 also shows the serum iron and Hb concentrations in rats at various time points.

FIG. 10A shows relative mRNA levels for HFE (left bar), TFR2 (middle bar), and HAMP (right bar) for each group. FIG. 10B shows UIBC (μg/dL) for each group. FIG. 10C shows the percent transferring saturation for each group. FIG. 10D shows serum iron concentration (μg/dL) for each group.

SUMMARY

Figure 1:
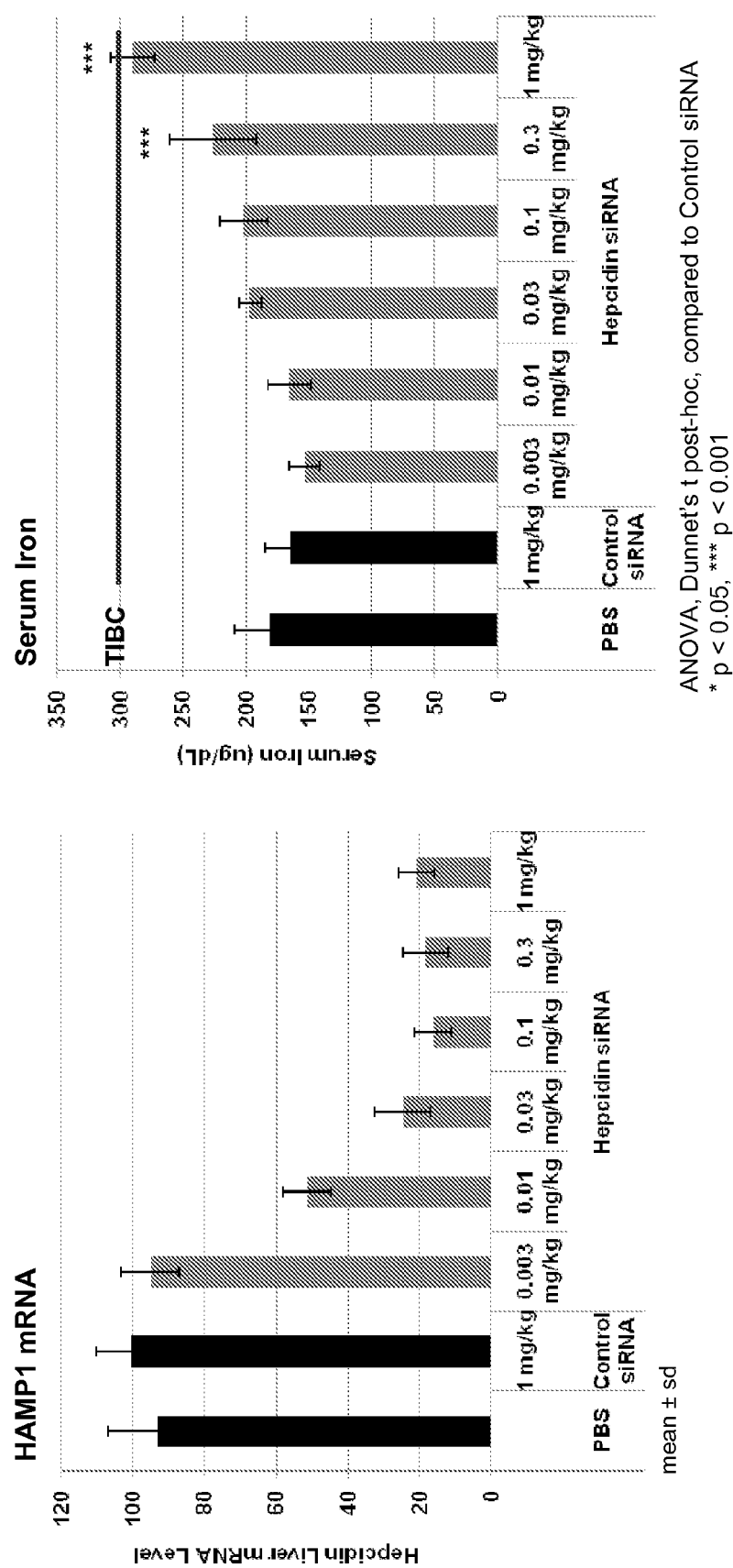
FIG. 1 shows the HAMP1 mRNA levels in mouse liver following various dosages of siRNA and the serum iron concentration (μg/dL) following various dosages of siRNA in mice.

Disclosed herein is a double-stranded ribonucleic acid (dsRNA) for inhibiting expression of hepcidin antimicrobial peptide (HAMP), wherein said dsRNA is selected from the dsRNAs listed in Table 2, 3, 4, or 5 with a start position of 379, 380, 382, or 385. In some aspects, the dsRNA consists of a dsRNA listed in Table 2, 3, 4, or 5 with a start position of 382.

Also described herein is a dsRNA for inhibiting expression of HAMP, wherein said dsRNA comprises a sense strand and an antisense strand, the antisense strand comprising a region of complementarity to a HAMP mRNA transcript, wherein the antisense strand comprises at least 15 contiguous nucleotides differing by no more than 3 nucleotides from one of the antisense strand sequences listed in Table 2, 3, 4, or 5.

In some aspects, the region of complementarity is at least 17 nucleotides in length. In some aspects, the region of complementarity is between 19 and 21 nucleotides in length. In some aspects, the region of complementarity is 19 nucleotides in length. In some aspects, the region of complementarity consists of one of the antisense strand sequences of Table 2, 3, 4, or 5.

In some aspects, the sense strand comprises 15 or more contiguous nucleotides of one of the sense strand sequences of Table 2, 3, 4, or 5. In some aspects, the antisense strand comprises 15 or more contiguous nucleotides of one of the antisense strand sequences of Table 2, 3, 4, or 5. In some aspects, the sense strand comprises 15 or more contiguous nucleotides of one of the sense strand sequences of Table 2, 3, 4, or 5 and the antisense strand comprises 15 or more contiguous nucleotides of one of the antisense strand sequences of Table 2, 3, 4, or 5. In some aspects, the sense strand comprises 16, 17, 18, 19, 20, or more contiguous nucleotides of one of the sense strand sequences of Table 2, 3, 4, or 5 and the antisense strand comprises 16, 17, 18, 19, 20, or more contiguous nucleotides of one of the antisense strand sequences of Table 2, 3, 4, or 5. In some aspects, the sense strand comprises one of the sense strand sequences of Table 2, 3, 4, or 5. In some aspects, the antisense strand comprises one of the antisense strand sequences of Table 2, 3, 4, or 5. In some aspects, the sense strand comprises one of the sense strand sequences of Table 2, 3, 4, or 5 and the antisense strand comprises one of the antisense strand sequences of Table 2, 3, 4, or 5. In some aspects, the sense strand consists of one of the sense strand sequences of Table 2, 3, 4, or 5 and the antisense strand consists of one of the antisense strand sequences of Table 2, 3, 4, or 5. In some aspects, the dsRNA mediates degradation of HAMP mRNA.

In some aspects, said dsRNA further comprises at least one modified nucleotide. In some aspects, at least one of said modified nucleotides is chosen from the group consisting of: a 2'-O-methyl modified nucleotide, a nucleotide comprising a 5'-phosphorothioate group, and a terminal nucleotide linked to a cholesteryl derivative or dodecanoic acid bisdecylamide group. In some aspects, said modified nucleotide is chosen from the group consisting of: a 2'-fluoro modified nucleotide, a 2'-fluoro modified nucleoside, a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

In some aspects, each strand is no more than 30 nucleotides in length. In some aspects, at least one strand comprises a 3' overhang of at least 1 nucleotide. In some aspects, at least one strand comprises a 3' overhang of at least 2 nucleotides. In some aspects, each strand comprises a 3' overhang of 2 nucleotides.

In some aspects, a dsRNA described above further comprises a ligand. In some aspects, the ligand is conjugated to the 3' end of the sense strand of the dsRNA. In some aspects, the dsRNA further comprises an N-Acetyl-Galactosamine (GalNac) conjugate.

In some aspects, a dsRNA described above is formulated in a nucleic acid lipid particle formulation. In some aspects, the nucleic acid lipid particle formulation is selected from Table A. In some aspects, the nucleic acid lipid particle formulation comprises MC3.

Also described herein is a cell comprising a dsRNA described above.

Also described herein is a vector encoding at least one strand of a dsRNA described above.

Also described herein is a cell comprising a vector described above.

Also described herein is a pharmaceutical composition for inhibiting expression of a HAMP gene comprising a dsRNA described above. In some aspects, the composition further comprises a lipid formulation. In some aspects, the lipid formulation is a nucleic acid lipid particle formulation.

Also described herein is a dsRNA for inhibiting expression of hemojuvelin (HFE2), wherein said dsRNA comprises a sense strand and an antisense strand, the antisense strand comprising a region of complementarity to a HFE2 mRNA transcript, wherein the antisense strand comprises at least 15 contiguous nucleotides differing by no more than 3 nucleotides from one of the antisense strand sequences listed in Table 10A.

In some aspects, the region of complementarity is at least 17 nucleotides in length. In some aspects, the region of complementarity is between 19 and 21 nucleotides in length. In some aspects, the region of complementarity is 19 nucleotides in length. In some aspects, the region of complementarity consists of one of the antisense strand sequences of Table 10A.

In some aspects, the sense strand comprises 15 or more contiguous nucleotides of one of the sense strand sequences of Table 10A. In some aspects, the antisense strand comprises 15 or more contiguous nucleotides of one of the antisense strand sequences of Table 10A. In some aspects, the sense strand comprises 15 or more contiguous nucleotides of one of the sense strand sequences of Table 10A and the antisense strand comprises 15 or more contiguous nucleotides of one of the antisense strand sequences of Table 10A. In some aspects, the sense strand comprises 16, 17, 18, 19, 20, or more contiguous nucleotides of one of the sense strand sequences of Table 10A and the antisense strand comprises 16, 17, 18, 19, 20, or more contiguous nucleotides of one of the antisense strand sequences of Table 10A. In some aspects, the sense strand comprises one of the sense strand sequences of Table 10A. In some aspects, the antisense strand comprises one of the antisense strand sequences of Table 10A. In some aspects, the sense strand comprises one of the sense strand sequences of Table 10A and the antisense strand comprises one of the antisense strand sequences of Table 10A. In some aspects, the sense strand consists of one of the sense strand sequences of Table 10A and the antisense strand consists of one of the antisense strand sequences of Table 10A. In some aspects, the dsRNA mediates degradation of HFE2 mRNA.

In some aspects, said dsRNA further comprises at least one modified nucleotide. In some aspects, at least one of said modified nucleotides is chosen from the group consisting of: a 2'-O-methyl modified nucleotide, a nucleotide comprising a 5'-phosphorothioate group, and a terminal nucleotide linked to a cholesteryl derivative or dodecanoic acid bisdecylamide group. In some aspects, said modified nucleotide is chosen from the group consisting of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

In some aspects, each strand is no more than 30 nucleotides in length. In some aspects, at least one strand comprises a 3' overhang of at least 1 nucleotide. In some aspects, at least one strand comprises a 3' overhang of at least 2 nucleotides. In some aspects, each strand comprises a 3' overhang of 2 nucleotides.

In some aspects, a dsRNA described above further comprises a ligand. In some aspects, the ligand is conjugated to the 3' end of the sense strand of the dsRNA. In some aspects, a dsRNA described above further comprises a GalNac conjugate.

In some aspects, the dsRNA is formulated in a nucleic acid lipid particle formulation. In some aspects, the nucleic acid lipid particle formulation is selected from Table A. In some aspects, the nucleic acid lipid particle formulation comprises MC3.

Also described herein is a cell comprising a dsRNA described above.

Also described herein is a vector encoding at least one strand of a dsRNA described above.

Also described herein is a cell comprising a vector described above.

Also described herein is a pharmaceutical composition for inhibiting expression of a HFE2 gene comprising a dsRNA described above. In some aspects, the composition further comprises a lipid formulation. In some aspects, the lipid formulation is a nucleic acid lipid particle formulation.

Also described herein is a dsRNA for inhibiting expression of transferrin receptor 2 (TFR2), wherein said dsRNA comprises a sense strand and an antisense strand, the antisense strand comprising a region of complementarity to a TFR2 mRNA transcript, wherein the antisense strand comprises at least 15 contiguous nucleotides differing by no more than 3 nucleotides from one of the antisense strand sequences listed in Table 10B or 13.

In some aspects, the region of complementarity is at least 17 nucleotides in length. In some aspects, the region of complementarity is between 19 and 21 nucleotides in length. In some aspects, the region of complementarity is 19 nucleotides in length. In some aspects, the region of complementarity consists of one of the antisense strand sequences of Table 10B or 13.

In some aspects, the sense strand comprises 15 or more contiguous nucleotides of one of the sense strand sequences of Table 10B or 13. In some aspects, the antisense strand comprises 15 or more contiguous nucleotides of one of the antisense strand sequences of Table 10B or 13. In some aspects, the sense strand comprises 15 or more contiguous nucleotides of one of the sense strand sequences of Table 10B or 13 and the antisense strand comprises 15 or more contiguous nucleotides of one of the antisense strand sequences of Table 10B or 13. In some aspects, the sense strand comprises 16, 17, 18, 19, 20, or more contiguous nucleotides of one of the sense strand sequences of Table 10B or 13 and the antisense strand comprises 16, 17, 18, 19, 20, or more contiguous nucleotides of one of the antisense strand sequences of Table 10B or 13. In some aspects, sense strand comprises one of the sense strand sequences of Table 10B or 13. In some aspects, the antisense strand comprises one of the antisense strand sequences of Table 10B or 13. In some aspects, the sense strand comprises one of the sense strand sequences Of Table 10B or 13 and the antisense strand comprises one of the antisense strand sequences of Table 10B or 13. In some aspects, the sense strand consists of one of the sense strand sequences of Table 10B or 13 and the antisense strand consists of one of the antisense strand sequences of Table 10B or 13. In some aspects, the dsRNA mediates degradation of TFR2 mRNA.

In some aspects, said dsRNA further comprises at least one modified nucleotide. In some aspects, at least one of said modified nucleotides is chosen from the group consisting of: a 2'-O-methyl modified nucleotide, a nucleotide comprising a 5'-phosphorothioate group, and a terminal nucleotide linked to a cholesteryl derivative or dodecanoic acid bisdecylamide group. In some aspects, said modified nucleotide is chosen from the group consisting of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

In some aspects, each strand is no more than 30 nucleotides in length. In some aspects, at least one strand comprises a 3' overhang of at least 1 nucleotide. In some aspects, at least one strand comprises a 3' overhang of at least 2 nucleotides. In some aspects, each strand comprises a 3 overhang of 2 nucleotides.

In some aspects, a dsRNA described above further comprises a ligand. In some aspects, the ligand is conjugated to the 3' end of the sense strand of the dsRNA. In some aspects, a dsRNA described above further comprises a GalNac conjugate.

In some aspects, the dsRNA is formulated in a nucleic acid lipid particle formulation. In some aspects, the nucleic acid lipid particle formulation is selected from Table A. In some aspects, the nucleic acid lipid particle formulation comprises MC3.

Also described herein is a cell comprising a dsRNA described above.

Also described herein is a vector encoding at least one strand of a dsRNA described above.

Also described herein is a cell comprising a vector described above.

Also described herein is a pharmaceutical composition for inhibiting expression of a TFR2 gene comprising a dsRNA described above. In some aspects, the composition further comprises a lipid formulation. In some aspects, the lipid formulation is a nucleic acid lipid particle formulation.

Also described herein is a composition comprising a first dsRNA for inhibiting expression of a HAMP gene and a second dsRNA for inhibiting expression of an HFE2 gene, wherein the first dsRNA comprises a first sense strand and an first antisense strand, the first antisense strand comprising a region of complementarity to a HAMP mRNA transcript, wherein the first antisense strand comprises at least 15 contiguous nucleotides differing by no more than 3 nucleotides from one of the antisense strand sequences listed in Table 2, 3, 4, or 5; and wherein the second dsRNA comprises a second sense strand and a second antisense strand, the second antisense strand comprising a region of complementarity to a HFE2 mRNA transcript, wherein the second antisense strand comprises at least 15 contiguous nucleotides differing by no more than 3 nucleotides from one of the antisense strand sequences listed in Table 10A.

Also described herein is a composition comprising a first dsRNA for inhibiting expression of a HAMP gene and a second dsRNA for inhibiting expression of an TFR2 gene, wherein said first dsRNA comprises a first sense strand and a first antisense strand, the first antisense strand comprising a region of complementarity to a HAMP mRNA transcript, wherein the first antisense strand comprises at least 15 contiguous nucleotides differing by no more than 3 nucleotides from one of the antisense strand sequences listed in Table 2, 3, 4, or 5; and wherein said second dsRNA comprises a second sense strand and a second antisense strand, the second antisense strand comprising a region of complementarity to a TFR2 mRNA transcript, wherein the second antisense strand comprises at least 15 contiguous nucleotides differing by no more than 3 nucleotides from one of the antisense strand sequences listed in Table 10B or 13.

Also described herein is a composition comprising a first dsRNA for inhibiting expression of a TFR2 gene and a second dsRNA for inhibiting expression of a HFE2 gene, wherein said first dsRNA comprises a first sense strand and a first antisense strand, the first antisense strand comprising a region of complementarity to a TFR2 mRNA transcript, wherein the first antisense strand comprises at least 15 contiguous nucleotides differing by no more than 3 nucleotides from one of the antisense strand sequences listed in Table 10B or 13; and wherein said second dsRNA comprises a second sense strand and a second antisense strand, the second antisense strand comprising a region of complementarity to a HFE2 mRNA transcript, wherein the second antisense strand comprises at least 15 contiguous nucleotides differing by no more than 3 nucleotides from one of the antisense strand sequences listed in Table 10A.

Also described herein is a composition comprising a plurality of dsRNAs selected From the dsRNAs described above.

Also described herein is a method of inhibiting HAMP expression in a cell, the Method comprising: (a) introducing into the cell a dsRNA described above; and (b) maintaining the cell produced in step (a) for a time sufficient to obtain degradation of the mRNA transcript of a HAMP gene, thereby inhibiting expression of the HAMP gene in the cell. In some aspects, the HAMP expression is inhibited by at least 30%. In some aspects, the HAMP expression is inhibited by at least 80%.

Also described herein is a method of treating a disorder associated with HAMP expression comprising administering to a subject in need of such treatment a therapeutically effective amount of a dsRNA described above.

In some aspects, the subject has anemia. In some aspects, the subject has refractory anemia. In some aspects, the subject has anemia of chronic disease (ACD). In some aspects, the subject has iron-restricted erythropoiesis. In some aspects, the subject is a human.

In some aspects, the dsRNA is administered at a concentration of 0.01 mg/kg-5 mg/kg bodyweight of the subject.

In some aspects, the dsRNA is lipid formulated. In some aspects, the dsRNA is lipid formulated in a formulation selected from Table A. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is conjugated to GalNac. In some aspects, the dsRNA is conjugated to GalNac and administered subcutaneously. In some aspects, the dsRNA is administered subcutaneously.

Also described herein is a method for treating anemia in a subject in need thereof comprising administering to the subject an effective amount of a HAMP dsRNA described above.

In some aspects, the dsRNA is lipid formulated. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is administered intravenously. In some aspects, the dsRNA is lipid formulated in a formulation selected from Table A. In some aspects, the dsRNA is conjugated to GalNac. In some aspects, the dsRNA is conjugated to GalNac and administered subcutaneously. In some aspects, the dsRNA is administered subcutaneously.

In some aspects, the subject is a primate or a rodent. In some aspects, the subject is a human.

In some aspects, the effective amount is a concentration of 0.01-5.0 mg/kg bodyweight of the subject.

In some aspects, the subject has fatigue, shortness of breath, headache, dizziness, or pale skin. In some aspects, the subject has reduced iron levels compared to a subject without anemia. In some aspects, the subject has haemoglobin (Hb) levels <9 g/dL. In some aspects, the subject has chronic kidney disease (CKD), cancer, chronic inflammatory disease, rheumatoid arthritis (RA), or iron-resistant iron-deficient amemia (IRIDA). In some aspects, the subject has reduced renal erythropoietin (EPO) synthesis compared to a subject without CKD, a dietary deficiency, blood loss, or elevated hepcidin levels compared to a subject without CKD. In some aspects, the subject has decreased renal excretion of hepcidin compared to a subject without CKD or low grade inflammation characterized by increased interleukin-6 (IL-6) levels compared to a subject without CKD. In some aspects, the subject has a reticulocyte Hb of <28 pg. In some aspects, the subject has >10% hypochromic red blood cells (RBCs). In some aspects, the method further comprises determining the complete blood count (CBC), serum iron concentration, Transferrin (Tf) saturation, or ferritin levels of the subject.

In some aspects, administering results in an increase in iron levels in the subject. In some aspects, administering results in a 2-fold increase in iron levels in the subject. In some aspects, administering results in an increase in Tf saturation in the subject.

In some aspects, the method further comprises determining the iron level in the subject. In some aspects, the method further comprises administering intravenous iron or ESAs to the subject.

Also described herein is a method of inhibiting HFE2 expression in a cell, the method comprising: (a) introducing into the cell a dsRNA described above; and (b) maintaining the cell produced in step (a) for a time sufficient to obtain degradation of the mRNA transcript of a HFE2 gene, thereby inhibiting expression of the HFE2 gene in the cell. In some aspects, the HFE2 expression is inhibited by at least 30%. In some aspects, the HFE2 expression is inhibited by at least 80%.

Also described herein is a method of treating a disorder associated with HFE2 expression comprising administering to a subject in need of such treatment a therapeutically effective amount of a dsRNA described above.

In some aspects, the subject has anemia. In some aspects, the subject has refractory anemia. In some aspects, the subject has anemia of chronic disease (ACD). In some aspects, the subject has iron-restricted erythropoiesis. In some aspects, the subject is a human.

In some aspects, the dsRNA is administered at a concentration of 0.01 mg/kg-5 mg/kg bodyweight of the subject.

In some aspects, the dsRNA is lipid formulated. In some aspects, the dsRNA is lipid formulated in a formulation selected from Table A. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is conjugated to GalNac. In some aspects, the dsRNA is conjugated to GalNac and administered subcutaneously. In some aspects, the dsRNA is administered subcutaneously.

Also described herein is a method for treating anemia in a subject in need thereof comprising administering to the subject an effective amount of a HFE2 dsRNA described above.

In some aspects, the dsRNA is lipid formulated. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is administered intravenously. In some aspects, the dsRNA is lipid formulated in a formulation selected from Table A. In some aspects, the dsRNA is conjugated to GalNac. In some aspects, the dsRNA is conjugated to GalNac and administered subcutaneously. In some aspects, the dsRNA is administered subcutaneously.

In some aspects, the subject is a primate or a rodent. In some aspects, the subject is a human.

In some aspects, the effective amount is a concentration of 0.01-5.0 mg/kg bodyweight of the subject.

In some aspects, the subject has fatigue, shortness of breath, headache, dizziness, or pale skin. In some aspects, the subject has reduced iron levels compared to a subject without anemia. In some aspects, the subject has haemoglobin (Hb) levels <9 g/dL. In some aspects, the Subject has chronic kidney disease (CKD), cancer, chronic inflammatory disease, rheumatoid arthritis (RA), or iron-resistant iron-deficient amemia (IRIDA). In some aspects, the subject has reduced renal erythropoietin (EPO) synthesis compared to a subject without CKD, a dietary deficiency, blood loss, or elevated hepcidin levels compared to a subject without CKD. In some aspects, the subject has decreased renal excretion of hepcidin compared to a subject without CKD or low grade inflammation characterized by increased interleukin-6 (IL-6) levels compared to a subject without CKD. In some aspects, the subject has a reticulocyte Hb of <28 pg. In some aspects, the subject has >10% hypochromic red blood cells (RBCs). In some aspects, the method further comprises determining the complete blood count (CBC), serum iron concentration. Transferrin (Tf) saturation, or ferritin levels of the subject.

In some aspects, administering results in an increase in iron levels in the subject. In some aspects, administering results in a 2-fold increase in iron levels in the subject. In some aspects, administering results in an increase in Tf saturation in the subject.

In some aspects, the method further comprises determining the iron level in the subject. In some aspects, the method further comprises administering intravenous iron or ESAs to the subject.

Also described herein is a method of inhibiting TFR2 expression in a cell, the method comprising: (a) introducing into the cell a dsRNA described above; and (b) maintaining the cell produced in step (a) for a time sufficient to obtain degradation of the mRNA transcript of a TFR2 gene, thereby inhibiting expression of the TFR2 gene in the cell. In some aspects, the TFR2 expression is inhibited by at least 30%. In some aspects, the TFR2 expression is inhibited by at least 80%.

Also described herein is a method of treating a disorder associated with TFR2 expression comprising administering to a subject in need of such treatment a therapeutically effective amount of a dsRNA described above.

In some aspects, the subject has anemia. In some aspects, the subject has refractory anemia. In some aspects, the subject has anemia of chronic disease (ACD). In some aspects, the subject has iron-restricted erythropoiesis. In some aspects, the subject is a human.

In some aspects, the dsRNA is administered at a concentration of 0.01 mg/kg-5 mg/kg bodyweight of the subject.

In some aspects, the dsRNA is lipid formulated. In some aspects, the dsRNA is lipid formulated in a formulation selected from Table A. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is conjugated to GalNac. In some aspects, the dsRNA is conjugated to GalNac and administered subcutaneously. In some aspects, the dsRNA is administered subcutaneously.

Also described herein is a method for treating anemia in a subject in need thereof comprising administering to the subject an effective amount of a TFR2 dsRNA described above.

In some aspects, the dsRNA is lipid formulated. In some aspects, the dsRNA is lipid formulated in a nucleic acid lipid particle formulation. In some aspects, the dsRNA is lipid formulated in a nucleic acid lipid particle formulation and administered intravenously. In some aspects, the dsRNA is administered intravenously. In some aspects, the dsRNA is lipid formulated in a formulation selected from Table A. In some aspects, the dsRNA is conjugated to GalNac. In some aspects, the dsRNA is conjugated to GalNac and administered subcutaneously. In some aspects, the dsRNA is administered subcutaneously.

In some aspects, the subject is a primate or a rodent. In some aspects, the subject is a human.

In some aspects, the effective amount is a concentration of 0.01-5.0 mg/kg bodyweight of the subject.

In some aspects, the subject has fatigue, shortness of breath, headache, dizziness, or Pale skin. In some aspects, the subject has reduced iron levels compared to a subject without anemia. In some aspects, the subject has haemoglobin (Hb) levels <9 g/dL. In some aspects, the subject has chronic kidney disease (CKD), cancer, chronic inflammatory disease, rheumatoid arthritis (RA), or iron-resistant iron-deficient amemia (IRIDA). In some aspects, the subject has reduced renal erythropoietin (EPO) synthesis compared to a subject without CKD, a dietary deficiency, blood loss, or elevated hepcidin levels compared to a subject without CKD. In some aspects, the subject has decreased renal excretion of hepcidin compared to a subject without CKD or low grade inflammation characterized by increased interleukin-6 (IL-6) levels compared to a subject without CKD. In some aspects, the subject has a reticulocyte Hb of <28 pg. In some aspects, the subject has >10% hypochromic red blood cells (RBCs). In some aspects, the method further comprises determining the complete blood count (CBC), serum iron concentration, Transferrin (Tf) saturation, or ferritin levels of the subject.

In some aspects, administering results in an increase in iron levels in the subject. In some aspects, administering results in a 2-fold increase in iron levels in the subject. In some aspects, administering results in an increase in Tf saturation in the subject.

In some aspects, the method further comprises determining the iron level in the subject. In some aspects, the method further comprises administering intravenous iron or ESAs to the subject.

Also described herein is a method of inhibiting HAMP, HFE2, and/or TFR2 expression in a cell, the method comprising: (a) introducing into the cell a plurality of dsRNAs selected from the dsRNAs described above; and (b) maintaining the cell produced in step (a) for a time sufficient to obtain degradation of the mRNA transcript of a HAMP, HFE2, and/or TFR2 gene, thereby inhibiting expression of the HAMP, HFE2, and/or TFR2 gene in the cell.

In some aspects, the plurality of dsRNAs are introduced simultaneously. In some aspects, the plurality of dsRNAs are introduced concurrently. In some aspects, the plurality of dsRNAs are introduced individually. In some aspects, the plurality of dsRNAs are introduced together. In some aspects, the expression is inhibited by at least 30%. In some aspects, the expression is inhibited by at least 80%.

Also described herein is a method of treating a disorder associated with HAMP, HFE2, and/or TFR2 expression comprising administering to a subject in need of such treatment a therapeutically effective amount of a plurality of dsRNAs selected from the dsRNAs described above.

In some aspects, the plurality of dsRNAs are administered to the subject simultaneously. In some aspects, the plurality of dsRNAs are administered to the subject concurrently. In some aspects, the plurality of dsRNAs are administered to the subject individually. In some aspects, the plurality of dsRNAs are administered to the subject together.

In some aspects, the subject has anemia. In some aspects, the subject has refractory anemia. In some aspects, the subject has anemia of chronic disease (ACD). In some aspects, the subject has iron-restricted erythropoiesis. In some aspects, the subject is a human. In some aspects, the plurality is administered at a concentration of 0.01 mg/kg-5 mg/kg bodyweight of the subject.

Also described herein is a method for treating anemia in a subject in need thereof comprising administering to the subject an effective amount of a plurality of dsRNAs selected from the dsRNAs described above.

In some aspects, the plurality of dsRNAs are administered to the subject simultaneously. In some aspects, the plurality of dsRNAs are administered to the subject concurrently. In some aspects, the plurality of dsRNAs are administered to the subject individually. In some aspects, the plurality of dsRNAs are administered to the subject together.

In some aspects, the plurality is lipid formulated. In some aspects, the plurality is lipid formulated in a nucleic acid lipid particle formulation. In some aspects, the plurality is lipid formulated in a nucleic acid lipid particle formulation and administered intravenously. In some aspects, the plurality is administered intravenously. In some aspects, the plurality is lipid formulated in a formulation selected from Table A. In some aspects, the plurality is conjugated to GalNac. In some aspects, the plurality is conjugated to GalNac and administered subcutaneously. In some aspects, the plurality is administered subcutaneously.

In some aspects, the subject is a primate or a rodent. In some aspects, the subject is a human.

In some aspects, the effective amount is a concentration of 0.01-5.0 mg/kg bodyweight of the subject.

In some aspects, the subject has fatigue, shortness of breath, headache, dizziness, or pale skin. In some aspects, the subject has reduced iron levels compared to a subject without anemia. In some aspects, the subject has haemoglobin (Hb) levels <9 g/dL. In some aspects, the subject has chronic kidney disease (CKD), cancer, chronic inflammatory disease, rheumatoid arthritis (RA), or iron-resistant iron-deficient amemia (IRIDA). In some aspects, the subject has reduced renal erythropoietin (EPO) synthesis compared to a subject without CKD, a dietary deficiency, blood loss, or elevated hepcidin levels compared to a subject without CKD. In some aspects, the subject has decreased renal excretion of hepcidin compared to a subject without CKD or low grade inflammation characterized by increased interleukin-6 (IL-6) levels compared to a subject without CKD. In some aspects, the subject has a reticulocyte Hb of <28 pg. In some aspects, the subject has >10% hypochromic red blood cells (RBCs). In some aspects, the method further comprises determining the complete blood count (CBC), serum iron concentration, Transferrin (Tf) saturation, or ferritin levels of the subject.

In some aspects, administering results in an increase in iron levels in the subject. In some aspects, administering results in a 2-fold increase in iron levels in the subject. In some aspects, administering results in an increase in Tf saturation in the subject.

In some aspects, the method further comprises determining the iron level in the subject. In some aspects, the method further comprises administering intravenous iron or ESAs to the subject.

DETAILED DESCRIPTION

The details of one or more embodiments are set forth in the description below. Other features, objects, and advantages will be apparent from the description and the drawings, and from the claims.

Provided herein are dsRNAs and methods of using the dsRNAs for inhibiting the expression of HAMP in a cell or a mammal where the dsRNA targets HAMP. Also provided are compositions and methods for treating pathological conditions and diseases in a mammal caused by the expression of HAMP. A HAMP dsRNA directs the sequence-specific degradation of HAMP mRNA.

Also provided herein are dsRNAs and methods of using the dsRNAs for inhibiting the expression of HFE2 in a cell or a mammal where the dsRNA targets HFE2. Also provided are compositions and methods for treating pathological conditions and diseases in a mammal caused by the expression of HFE2. A HFE2 dsRNA directs the sequence-specific degradation of HFE2 mRNA.

Also provided herein are dsRNAs and methods of using the dsRNAs for inhibiting the expression of HFE in a cell or a mammal where the dsRNA targets HFE. Also provided are compositions and methods for treating pathological conditions and diseases in a mammal caused by the expression of HFE. A HFE dsRNA directs the sequence-specific degradation of HFE mRNA.

Also provided herein are dsRNAs and methods of using the dsRNAs for inhibiting The expression of TFR2 in a cell or a mammal where the dsRNA targets TFR2. Also provided are compositions and methods for treating pathological conditions and diseases in a mammal caused by the expression of TFR2. A TFR2 dsRNA directs the sequence-specific degradation of TFR2 mRNA.

Also provided herein are dsRNAs and methods of using the dsRNAs for inhibiting the expression of BMPR1a in a cell or a mammal where the dsRNA targets BMPR1a. Also provided are compositions and methods for treating pathological conditions and diseases in a mammal caused by the expression of BMPR1a. A BMPR1a dsRNA directs the sequence-specific degradation of BMPR1a mRNA.

Also provided herein are dsRNAs and methods of using the dsRNAs for inhibiting the expression of SMAD4 in a cell or a mammal where the dsRNA targets SMAD4. Also provided are compositions and methods for treating pathological conditions and diseases in a mammal caused by the expression of SMAD4. A SMAD4 dsRNA directs the sequence-specific degradation of SMAD4 mRNA.

Also provided herein are dsRNAs and methods of using the dsRNAs for inhibiting The expression of IL6R in a cell or a mammal where the dsRNA targets IL6R. Also provided are compositions and methods for treating pathological conditions and diseases in a mammal caused by the expression of IL6R. An IL6R dsRNA directs the sequence-specific degradation of IL6R mRNA.

Also provided herein are dsRNAs and methods of using the dsRNAs for inhibiting the expression of BMP6 in a cell or a mammal where the dsRNA targets BMP6. Also provided are compositions and methods for treating pathological conditions and diseases in a mammal caused by the expression of BMP6. A BMP6 dsRNA directs the sequence-specific degradation of BMP6 mRNA.

Also provided herein are dsRNAs and methods of using the dsRNAs for inhibiting The expression of NEO1 in a cell or a mammal where the dsRNA targets NEO1. Also provided are compositions and methods for treating pathological conditions and diseases in a mammal caused by the expression of NEO1. A NEO1 dsRNA directs the sequence-specific degradation of NEO1 mRNA.

Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

"G," "C," "A" and "U" each generally stand for a nucleotide that contains guanine, cytosine, adenine, and uracil as a base, respectively. "T" and "dT" are used interchangeably herein and refer to a deoxyribonucleotide wherein the nucleobase is thymine, e.g., deoxyribothymine. However, it will be understood that the term "ribonucleotide" or "nucleotide" or "deoxyribonucleotide" can also refer to a modified nucleotide, as further detailed below, or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of the invention by a nucleotide containing, for example, inosine. Sequences comprising such replacement moieties are embodiments of the invention.

As used herein, "HAMP" refers to the hepcidin antimicrobial peptide gene, transcript, or protein (also known as LEAP). A human mRNA sequence for HAMP is Genbank accession NM_021175.2, included below as SEQ ID NO:1. Other examples of mammalian HAMP sequences are shown in Table B.

As used herein. "HFE2" refers to hemojuvelin gene, transcript, or protein. Examples of mammalian HFE2 sequences are shown in Table B.

As used herein. "TFR2" refers to transferrin receptor 2 gene, transcript, or protein. Examples of mammalian TFR2 sequences are shown in Table B.

As used herein, "HFE" refers to hemochromatosis gene, transcript, or protein. Examples of mammalian HFE sequences are shown in Table B.

As used herein, "BMPR1a" refers to bone morphogenetic protein receptor, type 1A gene, transcript, or protein. Examples of mammalian BMPR1a sequences are shown in Table B.

As used herein, "SMAD4" refers to SMAD family member 4 gene, transcript, or protein. Examples of mammalian SMAD4 sequences are shown in Table B.

As used herein, "IL6R" refers to interleukin 6 receptor gene, transcript, or protein. Examples of mammalian IL6R sequences are shown in Table B.

As used herein, "BMP6" refers to bone morphogenetic protein 6 gene, transcript, or protein. Examples of mammalian BMP6 sequences are shown in Table B.

As used herein, "NEO1" refers to neogenin homolog 1 gene, transcript, or protein. Examples of mammalian NEO1 sequences are shown in Table B.

As used herein, "HAMP-related" refers to a HFE2, HFE, TFR2, BMPR1a, SMAD4, IL6R, BMP6, and/or NEO1 gene, transcript, or protein.

As used herein, "target sequence" refers to a contiguous portion of the nucleotide sequence of an mRNA molecule formed during the transcription of a HAMP, HFE2, HFE, TFR2, BMPR1a, SMAD4, IL6R, BMP6, and/or NEO1 gene, including mRNA that is a product of RNA processing of a primary transcription product.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

This includes base-pairing of the oligonucleotide or polynucleotide comprising the First nucleotide sequence to the oligonucleotide or polynucleotide comprising the second nucleotide sequence over the entire length of the first and second nucleotide sequence. Such sequences can be referred to as "fully complementary" with respect to each other herein. However, where a first sequence is referred to as complementary with respect to a second sequence herein, the two sequences can be fully complementary, or they may be "substantially complementary," e.g., they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of a dsRNA and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding HAMP, HFE2, HFE, TFR2, BMPR1a, SMAD4, IL6R, BMP6, and/or NEO1) including a 5' UTR, an open reading frame (ORF), or a 3' UTR. For example, a polynucleotide is complementary to at least a part of a HAMP mRNA if the sequence is substantially complementary to a non-interrupted portion of an mRNA encoding HAMP.

The term "double-stranded RNA" or "dsRNA," as used herein, refers to a complex of ribonucleic acid molecules, having a duplex structure comprising two anti-parallel and substantially complementary, as defined above, nucleic acid strands. In general, the majority of nucleotides of each strand are ribonucleotides, but as described in detail herein, each or both strands can also include at least one non-ribonucleotide, e.g., a deoxyribonucleotide and/or a modified nucleotide. In addition, as used in this specification, "dsRNA" may include chemical modifications to ribonucleotides, including substantial modifications at multiple nucleotides and including all types of modifications disclosed herein or known in the art. Any such modifications, as used in an siRNA type molecule, are encompassed by "dsRNA" for the purposes of this specification and claims.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. The term "siRNA" is also used herein to refer to a dsRNA as described above.

As used herein, a "nucleotide overhang" refers to the unpaired nucleotide or nucleotides that protrude from the duplex structure of a dsRNA when a 3'-end of one strand of the dsRNA extends beyond the 5'-end of the other strand, or vice versa. "Blunt" or "blunt end" means that there are no unpaired nucleotides at that end of the dsRNA, i.e., no nucleotide overhang. A "blunt ended" dsRNA is a dsRNA that is double-stranded over its entire length, i.e., no nucleotide overhang at either end of the molecule.

The term "antisense strand" refers to the strand of a dsRNA which includes a region that is complementary, e.g., fully complementary or substantially complementary to a target sequence. As used herein, the term "region of complementarity" refers to the region on the antisense strand that is complementary to a sequence, for example a target sequence, as defined herein. Where the region of complementarity is not fully complementary to the target sequence, the mismatches are most tolerated in the terminal regions and, if present, are generally in a terminal region or regions, e.g., within 6, 5, 4, 3, or 2 nucleotides of the 5' and/or 3' terminus.

The term "sense strand," as used herein, refers to the strand of a dsRNA that includes a region that is complementary, e.g., fully or substantially complementary to a region of the antisense strand.

The term "start position" refers to a nucleotide position on the target mRNA where the 5' most nucleotide of a dsRNA sense strand aligns with the nucleotide position on the target mRNA. For example, a dsRNA with a start position of 382 on NM_021175.2 (SEQ ID NO:1) would include AD-11459 because position 382 on NM_021175.2 (SEQ ID NO: 1) is G and the sense sequence of AD-11459 is 5'-GAAcAuAGGucuuGGAAuAdTsdT-3' (SEQ ID NO: 30), where G is the 5' most nucleotide of the sense strand of AD-11459; thus G at position 382 on NM_021175.2 (SEQ ID NO:1) is the start position of AD-11459.

As used herein, the term "nucleic acid lipid particle" includes the term "SNALP" and refers to a vesicle of lipids coating a reduced aqueous interior comprising a nucleic acid such as a dsRNA or a plasmid from which a dsRNA is transcribed. Nucleic acid lipid particles, e.g., SNALP are described, e.g., in U.S. Patent Application Publication Nos. 20060240093, 20070135372, and U.S. Ser. No. 61/045,228 filed on Apr. 15, 2008. These applications are hereby incorporated by reference.

"Introducing into a cell," when referring to a dsRNA, means facilitating uptake or absorption into the cell, as is understood by those skilled in the art. Absorption or uptake of dsRNA can occur through unaided diffusive or active cellular processes, or by auxiliary agents or devices. The meaning of this term is not limited to cells in vitro; a dsRNA may also be "introduced into a cell," wherein the cell is part of a living organism. In such instance, introduction into the cell will include the delivery to the organism. For example, for in vivo delivery, dsRNA can be injected into a tissue site or administered systemically. In vitro introduction into a cell includes methods known in the art such as electroporation and lipofection. Further approaches are described herein or known in the art.

The terms "silence," "inhibit the expression of," "downregulate the expression of," "suppress the expression of" and the like in as far as they refer to a HAMP, HFE2, HFE, TFR2, BMPR1a, SMAD4, IL6R, BMP6, and/or NEO1 gene, herein refer to the at least partial suppression of the expression of a HAMP, HFE2, HFE, TFR2, BMPR1a, SMAD4, IL6R, BMP6, and/or NEO1 gene, as manifested by a reduction of the amount of mRNA which may be isolated from a first cell or group of cells in which a HAMP, HFE2, HFE, TFR2, BMPR1a, SMAD4, IL6R. BMP6, and/or NEO1 gene is transcribed and which has or have been treated such that the expression of a HAMP, HFE2, HFE, TFR2, BMPR1a, SMAD4, IL6R, BMP6, and/or NEO1 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\%$$

Alternatively, the degree of inhibition may be given in terms of a reduction of a parameter that is functionally linked to HAMP, HFE2, HFE, TFR2, BMPR1a, SMAD4, IL6R, BMP6, and/or NEO1 gene expression, e.g., the amount of protein encoded by a HAMP, HFE2, HFE, TFR2, BMPR1a, SMAD4, IL6R, BMP6, and/or NEO1 gene which is secreted by a cell, or the number of cells displaying a certain phenotype, e.g., apoptosis. In principle, HAMP, HFE2, HFE, TFR2, BMPR1a, SMAD4, IL6R, BMP6, and/or NEO1 gene silencing may be determined in any cell expressing the target, either constitutively or by genomic engineering, and by any appropriate assay. However, when a reference is needed in order to determine whether a given dsRNA inhibits the expression of a HAMP, HFE2, HFE, TFR2, BMPR1a, SMAD4, IL6R, BMP6, and/or NEO1 gene by a certain degree and therefore is encompassed by the instant invention, the assays provided in the Examples below shall serve as such reference.

For example, in certain instances, expression of a HAMP, HFE2, HFE, TFR2, BMPR1a, SMAD4, IL6R, BMP6, and/or NEO1 gene is suppressed by at least about 5%, 10%, 15%, 20%, 25%, 30%, 35%, 40%, 45%, or 50% by administration of the double-stranded oligonucleotide featured in the invention. In some embodiments, a HAMP, HFE2, HFE, TFR2. BMPR1a, SMAD4, IL6R, BMP6, and/or NEO1 gene is suppressed by at least about 60%, 70%, or 80% by administration of the double-stranded oligonucleotide featured in the invention. In some embodiments, a HAMP, HFE2, HFE, TFR2, BMPR1a, SMAD4, IL6R, BMP6, and/or NEO1 gene is suppressed by at least about 85%, 90%, or 95% by administration of the double-stranded oligonucleotide featured in the invention.

As used herein in the context of HAMP, HFE2, HFE, TFR2, BMPR1a, SMAD4, IL6R, BMP6, and/or NEO1 expression, the terms "treat," "treatment," and the like, refer to relief from or alleviation of pathological processes mediated by HAMP, HFE2, HFE, TFR2, BMPR1a, SMAD4, IL6R, BMP6, and/or NEO expression. In the context of the present invention insofar as it relates to any of the other conditions recited herein below (other than pathological processes mediated by HAMP, HFE2, HFE, TFR2, BMPR1a, SMAD4, IL6R, BMP6, and/or NEO1 expression), the terms "treat," "treatment," and the like mean to relieve or alleviate at least one symptom associated with such condition, or to slow or reverse the progression of such condition.

As used herein, the phrases "effective amount" refers to an amount that provides a benefit in the treatment, prevention, or management of pathological processes mediated by HAMP, HFE2, HFE, TFR2, BMPR1a, SMAD4, IL6R, BMP6, and/or NEO1 expression or an overt symptom of pathological processes mediated by HAMP, HFE2, HFE, TFR2. BMPR1a, SMAD4, IL6R, BMP6, and/or NEO1 expression. The specific amount that is effective can be readily determined by an ordinary medical practitioner, and may vary depending on factors known in the art, such as, for example, the type of pathological processes mediated by HAMP, HFE2, HFE, TFR2, BMPR1a, SMAD4, IL6R, BMP6, and/or NEO1 expression, the patient's history and age, the stage of pathological processes mediated by HAMP, HFE2, HFE, TFR2, BMPR1a, SMAD4, IL6R, BMP6, and/or NEO1 expression, and the administration of other anti-pathological processes mediated by HAMP, HFE2, HFE, TFR2, BMPR1a, SMAD4, IL6R, BMP6, and/or NEO1 expression agents.

As used herein, a "pharmaceutical composition" comprises a pharmacologically effective amount of a dsRNA and a pharmaceutically acceptable carrier. As used herein, "pharmacologically effective amount," or simply "effective amount" refers to that amount of an RNA effective to produce the intended pharmacological, therapeutic or preventive result. For example, if a given clinical treatment is considered effective when there is at least a 25% reduction in a measurable parameter associated with a disease or disorder, a pharmacologically effective amount of a drug for the treatment of that disease or disorder is the amount necessary to effect at least a 25% reduction in that parameter. For example, a pharmacologically effective amount of a dsRNA targeting HAMP can reduce HAMP serum levels by at least 25%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract.

As used herein, a "transformed cell" is a cell into which a vector has been introduced from which a dsRNA molecule may be expressed.

Double-Stranded Ribonucleic Acid (dsRNA)

As described in more detail herein, the invention provides double-stranded Ribonucleic acid (dsRNA) molecules for inhibiting the expression of a HAMP, HFE2, HFE, TFR2, BMPR1a, SMAD4, IL6R, BMP6, and/or NEO1 gene in a cell or mammal, where the dsRNA includes an antisense strand having a region of complementarity which is complementary to at least a part of an mRNA formed in the expression of a HAMP, HFE2, HFE, TFR2, BMPR1a, SMAD4, IL6R, BMP6, and/or NEO1 gene, and where the region of complementarity is less than 30 nucleotides in length, generally 19-24 nucleotides in length, and where said dsRNA, upon contact with a cell expressing said HAMP, HFE2, HFE, TFR2. BMPR1a, SMAD4, IL6R. BMP6, and/or NEO1 gene, inhibits the expression of said HAMP, HFE2, HFE, TFR2, BMPR1a, SMAD4, IL6R, BMP6, and/or NEO1 gene by at least 30% as assayed by, for example, a PCR or branched DNA (bDNA)-based method, or by a protein-based method, such as by Western blot. Expression of a HAMP, HFE2, HFE, TFR2, BMPR1a, SMAD4, IL6R, BMP6, and/or NEO1 gene can be reduced by at least 30% when measured by an assay as described in the Examples below. For example, expression of a HAMP gene in cell culture, such as in Hep3B cells, can be assayed by measuring HAMP mRNA levels, such as by bDNA or TaqMan assay, or by measuring protein levels, such as by ELISA assay. The dsRNA of the invention can further include one or more single-stranded nucleotide overhangs.

The dsRNA can be synthesized by standard methods known in the art as further discussed below, e.g., by use of an automated DNA synthesizer, such as are commercially available from, for example, Biosearch, Applied Biosystems, Inc. The dsRNA includes two RNA strands that are sufficiently complementary to hybridize to form a duplex structure. One strand of the dsRNA (the antisense strand) includes a region of complementarity that is substantially complementary, and generally fully complementary, to a target sequence, derived from the sequence of an mRNA formed during the expression of a HAMP, HFE2, HFE, TFR2, BMPR1a, SMAD4, IL6R, BMP6, and/or NEO1 gene, the other strand (the sense strand) includes a region that is complementary to the antisense strand, such that the two strands hybridize and form a duplex structure when combined under suitable conditions. Generally, the duplex structure is between 15 and 30 or between 25 and 30, or between 18 and 25, or between 19 and 24, or between 19 and 21, or 19, 20, or 21 base pairs in length. In one embodiment the duplex is 19 base pairs in length. In another embodiment the duplex is 21 base pairs in length. When two different dsRNAs are used in combination, the duplex lengths can be identical or can differ. In one embodiment, the antisense strand of the dsRNA is sufficiently complementary to a target mRNA (e.g., a HAMP, HFE2, HFE, TFR2, BMPR1a, SMAD4, IL6R, BMP6, and/or NEO1 mRNA) so as to cause cleavage of the target mRNA.

Each strand of the dsRNA of invention is generally between 15 and 30, or between 18 and 25, or 18, 19, 20, 21, 22, 23, 24, or 25 nucleotides in length. In other embodiments, each is strand is 25-30 nucleotides in length. Each strand of the duplex can be the same length or of different lengths. When two different siRNAs are used in combination, the lengths of each strand of each siRNA can be identical or can differ.

The dsRNA of the invention can include one or more single-stranded overhang(s) of one or more nucleotides. In one embodiment, at least one end of the dsRNA has a single-stranded nucleotide overhang of 1 to 4, generally 1 or 2 nucleotides. In another embodiment, the antisense strand of the dsRNA has 1-10 nucleotides overhangs each at the 3' end and the 5' end over the sense strand. In further embodiments, the sense strand of the dsRNA has 1-10 nucleotides overhangs each at the 3' end and the 5' end over the antisense strand. The dsRNA can include a 3' overhang of 2 nucleotides on both the sense and antisense strands.

A dsRNAs having at least one nucleotide overhang can have unexpectedly superior inhibitory properties than the blunt-ended counterpart. In some embodiments the presence of only one nucleotide overhang strengthens the interference activity of the dsRNA, without affecting its overall stability. A dsRNA having only one overhang has proven particularly stable and effective in vivo, as well as in a variety of cells, cell culture mediums, blood, and serum. Generally, the single-stranded overhang is located at the 3'-terminal end of the antisense strand or, alternatively, at the 3'-terminal end of the sense strand. The dsRNA can also have a blunt end, generally located at the 5'-end of the antisense strand. Such dsRNAs can have improved stability and inhibitory activity, thus allowing administration at low dosages, i.e., less than 5 mg/kg body weight of the recipient per day. Generally, the antisense strand of the dsRNA has a nucleotide overhang at the 3'-end, and the 5'-end is blunt. In another embodiment, one or more of the nucleotides in the overhang is replaced with a nucleoside thiophosphate.

In one embodiment, a HAMP gene is a human HAMP gene. In specific embodiments, the sense strand of the dsRNA is one of the sense sequences from Tables 2, 3, 4, and 5, and the antisense strand is one of the antisense sequences of Tables 2, 3, 4, and 5. Alternative antisense agents that target elsewhere in the target sequence provided in Tables 2, 3, 4, and 5 can readily be determined using the target sequence and the flanking HAMP sequence.

The skilled person is well aware that dsRNAs having a duplex structure of between 20 and 23, but specifically 21, base pairs have been hailed as particularly effective in inducing RNA interference (Elbashir et al., EMBO 2001, 20:6877-6888). However, others have found that shorter or longer dsRNAs can be effective as well. In the embodiments described above, by virtue of the nature of the oligonucleotide sequences provided in Tables 2, 3, 4, and 5, the dsRNAs featured in the invention can include at least one strand of a length described herein. It can be reasonably expected that shorter dsRNAs having one of the sequences of Tables 2, 3, 4, and 5 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Tables 2, 3, 4, and 5, and differing in their ability to inhibit the expression of a HAMP gene in an assay as described herein below by not more than 5, 10, 15, 20, 25, or 30% inhibition from a dsRNA comprising the full sequence, are contemplated by the invention. Further, dsRNAs that cleave within a desired HAMP target sequence can readily be made using the corresponding HAMP antisense sequence and a complementary sense sequence.

In addition, the dsRNAs provided in Tables 2, 3, 4, and 5 identify a site in a HAMP that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Tables 2, 3, 4, and 5 coupled to additional nucleotide sequences taken from the region contiguous to the selected sequence in a HAMP gene.

In one embodiment, a HFE2 gene is a human HFE2 gene. In specific embodiments, the sense strand of the dsRNA is one of the sense sequences from Table 10A, and the antisense strand is one of the antisense sequences of Table 10A. Alternative antisense agents that target elsewhere in the target sequence provided in Table 10A can readily be determined using the target sequence and the flanking HFE2 sequence.

In the embodiments described above, by virtue of the nature of the oligonucleotide sequences provided in Table 10A, the dsRNAs featured in the invention can include at least one strand of a length described herein. It can be reasonably expected that shorter dsRNAs having one of the sequences of Table 10A minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 10A, and differing in their ability to inhibit the expression of a HFE2 gene in an assay as described herein below by not more than 5, 10, 15, 20, 25, or 30% inhibition from a dsRNA comprising the full sequence, are contemplated by the invention. Further, dsRNAs that cleave within a desired HFE2 target sequence can readily be made using the corresponding HFE2 antisense sequence and a complementary sense sequence.

In addition, the dsRNAs provided in Table 10A identify a site in a HFE2 that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Table 10A coupled to additional nucleotide sequences taken from the region contiguous to the selected sequence in a HFE2 gene.

In one embodiment, a TFR2 gene is a human TFR2 gene. In specific embodiments, the sense strand of the dsRNA is one of the sense sequences from Table 10B or 13, and the antisense strand is one of the antisense sequences of Table 10B or 13. Alternative antisense agents that target elsewhere in the target sequence provided in Table 10B or 13 can readily be determined using the target sequence and the flanking TFR2 sequence.

In the embodiments described above, by virtue of the nature of the oligonucleotide sequences provided in Table 10B or 13, the dsRNAs featured in the invention can include at least one strand of a length described herein. It can be reasonably expected that shorter dsRNAs having one of the sequences of Table 10B or 13 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 10B or 13, and differing in their ability to inhibit the expression of a TFR2 gene in an assay as described herein below by not more than 5, 10, 15, 20, 25, or 30% inhibition from a dsRNA comprising the full sequence, are contemplated by the invention. Further, dsRNAs that cleave within a desired TFR2 target sequence can readily be made using the corresponding TFR2 antisense sequence and a complementary sense sequence.

In addition, the dsRNAs provided in Table 10B or 13 identify a site in a TFR2 that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Table 10B or 13 coupled to additional nucleotide sequences taken from the region contiguous to the selected sequence in a TFR2 gene.

In one embodiment, a SMAD4 gene is a human SMAD4 gene. In specific embodiments, the sense strand of the dsRNA is one of the sense sequences from Table 15 or 16, and the antisense strand is one of the antisense sequences of Table 15 or 16. Alternative antisense agents that target elsewhere in the target sequence provided in Table 15 or 16 can readily be determined using the target sequence and the flanking SMAD4 sequence.

In the embodiments described above, by virtue of the nature of the oligonucleotide sequences provided in Table 15 or 16, the dsRNAs featured in the invention can include at least one strand of a length described herein. It can be reasonably expected that shorter dsRNAs having one of the sequences of Table 15 or 16 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 15 or 16, and differing in their ability to inhibit the expression of a SMAD4 gene in an assay as described herein below by not more than 5, 10, 15, 20, 25, or 30% inhibition from a dsRNA comprising the full sequence, are contemplated by the invention. Further, dsRNAs that cleave within a desired SMAD4 target sequence can readily be made using the corresponding SMAD4 antisense sequence and a complementary sense sequence.

In addition, the dsRNAs provided in Table 15 or 16 identify a site in a SMAD4 that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Table 15 or 16 coupled to additional nucleotide sequences taken from the region contiguous to the selected sequence in a SMAD4 gene.

In one embodiment, a NEO1 gene is a human NEO1 gene. In specific embodiments, the sense strand of the dsRNA is one of the sense sequences from Table 17 or 18, and the antisense strand is one of the antisense sequences of Table 17 or 18. Alternative antisense agents that target elsewhere in the target sequence provided in Table 17 or 18 can readily be determined using the target sequence and the flanking NEO1 sequence.

In the embodiments described above, by virtue of the nature of the oligonucleotide sequences provided in Table 17 or 18, the dsRNAs featured in the invention can include at least one strand of a length described herein. It can be reasonably expected that shorter dsRNAs having one of the sequences of Table 17 or 18 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 17 or 18, and differing in their ability to inhibit the expression of a NEO1 gene in an assay as described herein below by not more than 5, 10, 15, 20, 25, or 30% inhibition from a dsRNA comprising the full sequence, are contemplated by the invention. Further, dsRNAs that cleave within a desired NEO1 target sequence can readily be made using the corresponding NEO1 antisense sequence and a complementary sense sequence.

In addition, the dsRNAs provided in Table 17 or 18 identify a site in a NEO1 that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Table 17 or 18 coupled to additional nucleotide sequences taken from the region contiguous to the selected sequence in a NEO1 gene.

In one embodiment, a BMP6 gene is a human BMP6 gene. In specific embodiments, the sense strand of the dsRNA is one of the sense sequences from Table 21, and the antisense strand is one of the antisense sequences of Table 21. Alternative antisense agents that target elsewhere in the target sequence provided in Table 21 can readily be determined using the target sequence and the flanking BMP6 sequence.

In the embodiments described above, by virtue of the nature of the oligonucleotide sequences provided in Table 21, the dsRNAs featured in the invention can include at least one strand of a length described herein. It can be reasonably expected that shorter dsRNAs having one of the sequences of Table 21 minus only a few nucleotides on one or both ends may be similarly effective as compared to the dsRNAs described above. Hence, dsRNAs having a partial sequence of at least 15, 16, 17, 18, 19, 20, or more contiguous nucleotides from one of the sequences of Table 21, and differing in their ability to inhibit the expression of a BMP6 gene in an assay as described herein below by not more than 5, 10, 15, 20, 25, or 30% inhibition from a dsRNA comprising the full sequence, are contemplated by the invention. Further, dsRNAs that cleave within a desired BMP6 target sequence can readily be made using the corresponding BMP6 antisense sequence and a complementary sense sequence.

In addition, the dsRNAs provided in Table 21 identify a site in a BMP6 that is susceptible to RNAi based cleavage. As such, the present invention further features dsRNAs that target within the sequence targeted by one of the agents of the present invention. As used herein, a second dsRNA is said to target within the sequence of a first dsRNA if the second dsRNA cleaves the message anywhere within the mRNA that is complementary to the antisense strand of the first dsRNA. Such a second dsRNA will generally consist of at least 15 contiguous nucleotides from one of the sequences provided in Table 21 coupled to additional nucleotide sequences taken from the region contiguous to the selected sequence in a BMP6 gene.

With regard to Tables 4, 10A, 10B, 13, 16, 18, and 21: It should be noted that unmodified versions of each of the modified sequences shown are included within the scope of the invention. "Unmodified version" refers to a sequence that does not include one or more chemical modifications, e.g., a 2'-O methyl group, a phosphorothioate, and/or a 2'-fluoro group. For example, included in the invention are unmodified versions of AD-47391, which targets HFE2. See Table 10A. Unmodified sense strand versions of AD-47391 include: AGAGUAGGGAAUCAUGGCUdTdT (SEQ ID NO: 31) and AGAGUAGGGAAUCAUGGCU (SEQ ID NO: 32). Unmodified antisense strand versions of AD-47391 include: AGCCAUGAUUCCCUACUCUdTdT (SEQ ID NO: 33)and AGCCAUGAUUCCCUACUCU (SEQ ID NO: 34). As another example, included in the invention are unmodified versions of AD-47826, which targets TFR2. See Table 10B. Unmodified sense strand versions of AD-47826 include: CAGGCAGCCAAACCUCAUUdTdT (SEQ ID NO: 35)and CAGGCAGCCAAACCUCAUU (SEQ ID NO: 36). Unmodified antisense strand versions of AD-47826 include: AAUGAGGUUUGGCUGCCUG (SEQ ID NO: 37)and AAUGAGGUUUGGCUGCCUGdTdT (SEQ ID NO: 38).

Cleavage of the RNA target can be routinely detected by gel electrophoresis and, if necessary, associated nucleic acid hybridization techniques known in the art. The cleavage site on the target mRNA of a dsRNA can be determined using methods generally known to one of ordinary skill in the art, e.g., the 5'-RACE method described in Soutschek et al., Nature; 2004, Vol. 432, pp. 173-178 (which is herein incorporated by reference for all purposes). Included in the invention are dsRNA that cleave the RNA target at the same location as the dsRNA described in the tables herein.

The dsRNA featured in the invention can contain one or more mismatches to the target sequence. In one embodiment, the dsRNA featured in the invention contains no more than 3 mismatches. If the antisense strand of the dsRNA contains mismatches to a target sequence, it is preferable that the area of mismatch not be located in the center of the region of complementarity. If the antisense strand of the dsRNA contains mismatches to the target sequence, it is preferable that the mismatch be restricted to 5 nucleotides from either end, for example 5, 4, 3, 2, or 1 nucleotide from either the 5' or 3' end of the region of complementarity. For example, for a 23 nucleotide dsRNA strand which is complementary to a region of a HAMP gene, the dsRNA generally does not contain any mismatch within the central 13 nucleotides. The methods described within the invention can be used to determine whether a dsRNA containing a mismatch to a target sequence is effective in inhibiting the expression of a HAMP, HFE2, HFE, TFR2, BMPR1a, SMAD4, IL6R, BMP6, and/or NEO1 gene. Consideration of the efficacy of dsRNAs with mismatches in inhibiting expression of a HAMP, HFE2, HFE, TFR2, BMPR1a, SMAD4, IL6R. BMP6, and/or NEO1 gene is important, especially if the particular region of complementarity in a HAMP, HFE2, HFE, TFR2, BMPR1a, SMAD4, IL6R, BMP6, and/or NEO1 gene is known to have polymorphic sequence variation within the population.

Modifications

In yet another embodiment, the dsRNA is chemically modified to enhance stability. The nucleic acids featured in the invention may be synthesized and/or modified by methods well established in the art, such as those described in "Current protocols in nucleic acid chemistry," Beaucage, S. L. et al. (Eds.), John Wiley & Sons, Inc., New York, N.Y., USA, which is hereby incorporated herein by reference. Specific examples of dsRNA compounds useful in this invention include dsRNAs containing modified backbones or no natural internucleoside linkages. As defined in this specification, dsRNAs having modified backbones include those that retain a phosphorus atom in the backbone and those that do not have a phosphorus atom in the backbone. For the purposes of this specification, and as sometimes referenced in the art, modified dsRNAs that do not have a phosphorus atom in their internucleoside backbone can also be considered to be oligonucleosides.

Modified dsRNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those) having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; and 5,625,050, each of which is herein incorporated by reference Modified dsRNA backbones that do not include a phosphorus atom therein have backbones that are formed by short chain alkyl or cycloalkyl internucleoside linkages, mixed heteroatoms and alkyl or cycloalkyl internucleoside linkages, or ore or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. In some instances, dsRNAs can be made with "Light Fluoro" chemical modifications as follows: all pyrimidines (cytosine and uridine) in the sense strand can be replaced with corresponding 2'-Fluoro bases (2' Fluoro C and 2'-Fluoro U). In the antisense strand, pyrimidines adjacent to (towards 5' position) ribo A nucleoside can be replaced with their corresponding 2-Fluoro nucleosides.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, each of which is herein incorporated by reference.

In other suitable dsRNA mimetics, both the sugar and the internucleoside linkage, i.e., the backbone, of the nucleotide units are replaced with novel groups. The base units are maintained for hybridization with an appropriate nucleic acid target compound. One such oligomeric compound, a dsRNA mimetic that has been shown to have excellent hybridization properties, is referred to as a peptide nucleic acid (PNA). In PNA compounds, the sugar backbone of a dsRNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331: and 5,719,262, each of which is herein incorporated by reference. Further teaching of PNA compounds can be found in Nielsen et al., Science, 1991, 254, 1497-1500.

Other embodiments of the invention are dsRNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. Also preferred are dsRNAs having morpholino backbone structures of the above-referenced U.S. Pat. No. 5,034,506.

Modified dsRNAs may also contain one or more substituted sugar moieties. Preferred dsRNAs comprise one of the following at the 2' position: OH; F: O—, S—, or N-alkyl; O—, S—, or N-alkenyl; O—, S—or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Particularly preferred are O[($CH_2$)$_n$O]$_m$$CH_3$, O($CH_2$)$_n$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. Other preferred dsRNAs comprise one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an dsRNA, or a group for improving the pharmacodynamic properties of an dsRNA, and other substituents having similar properties. A preferred modification includes 2'-methoxyethoxy(2'-O—$CH_2CH_2OCH_3$, also known as 2'-O-(2-methoxyethyl) or 2'-MOE) (Martin et al., Helv. Chim. Acta, 1995, 78, 486-504) i.e., an alkoxy-alkoxy group. A further preferred modification includes 2'-dimethylaminooxyethoxy, i.e., a O($CH_2$)$_2$ON($CH_3$)$_2$ group, also known as 2'-DMAOE, as described in examples herein below, and 2'-dimethylamino-ethoxyethoxy (also known in the art as 2'-O-dimethylamino-ethoxyethyl or 2'-DMAEOE), i.e., 2'-O—$CH_2$—O—$CH_2$—N($CH_2$)$_2$, also described in examples herein below.

Other preferred modifications include 2'-methoxy(2'-O$CH_3$), 2'-aminopropoxy(2'-O$CH_2CH_2CH_2NH_2$) and 2'-fluoro(2'-F). Similar modifications may also be made at other positions on the dsRNA, particularly the 3' position of the sugar on the 3' terminal nucleotide or in 2'-5' linked dsRNAs and the 5' position of 5' terminal nucleotide. DsRNAs may also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application, and each of which is herein incorporated by reference in its entirety.

dsRNAs may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, DsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., DsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; and 5,681,941, each of which is herein incorporated by reference, and U.S. Pat. No. 5,750,692, also herein incorporated by reference.

Conjugates

Another modification of the dsRNAs of the invention involves chemically linking to the dsRNA one or more moieties or conjugates which enhance the activity, cellular distribution or cellular uptake of the dsRNA. Such moieties include but are not limited to lipid moieties such as a cholesterol moiety (Letsinger et al., Proc. Natl. Acid. Sci. USA, 1989, 86: 6553-6556), cholic acid (Manoharan et al., Biorg. Med. Chem. Let., 1994, 4:1053-1060), a thioether, e.g., beryl-5-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330: Svinarchuk et al., Biochimie, 1993, 75:49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim. Biophys. Acta, 1995, 1264:229-237), or an octadecylamine or hexylamino-carbonyloxycholesterol moiety (Crooke et al., J. Pharmacol. Exp. Ther., 1996, 277:923-937).

In some embodiments of the compositions and methods of the invention, an dsRNA oligonucleotide further comprises a carbohydrate. The carbohydrate conjugated dsRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g. C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide. In one embodiment, the monosaccharide is an N-acetyl-galactosamine, such as

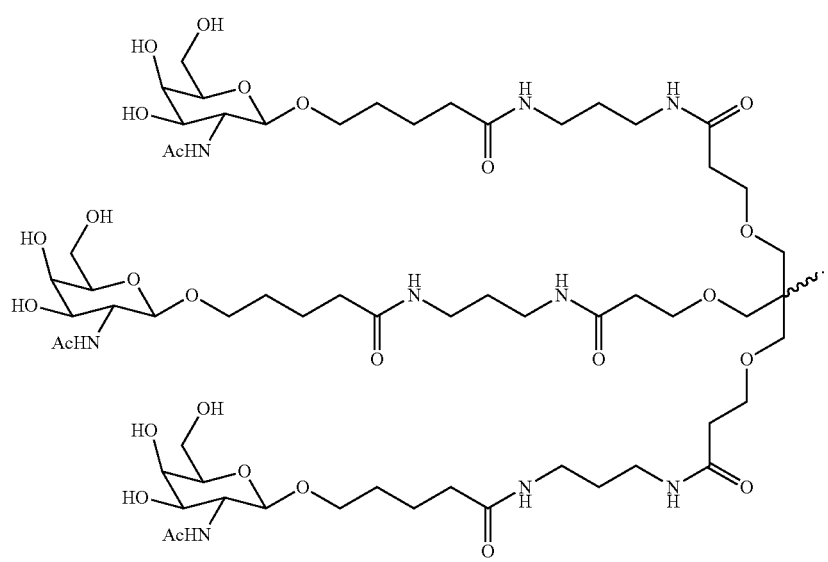

Formula II

In another embodiment, a carbohydrate conjugate for use in the compositions and methods of the invention is selected from the group consisting of:

Formula II
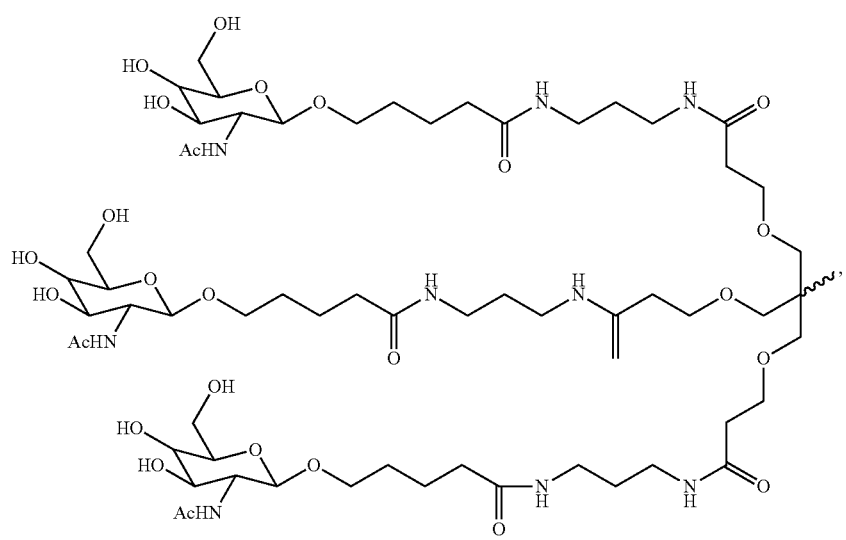
Formula III
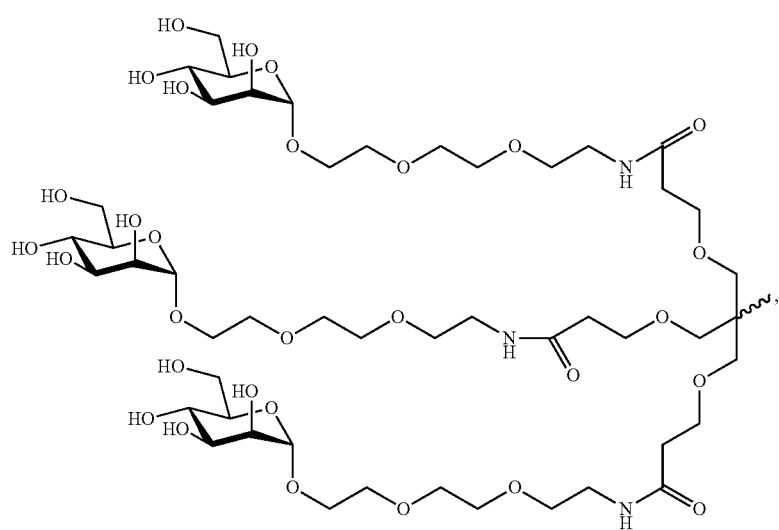
Formula IV
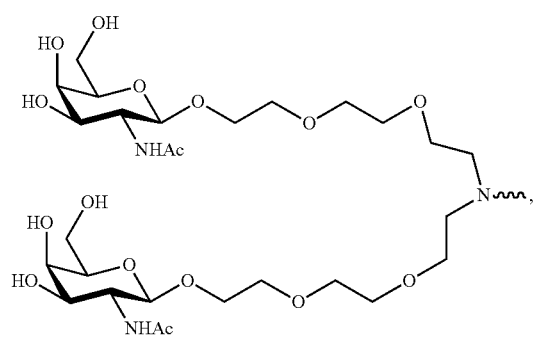
Formula V
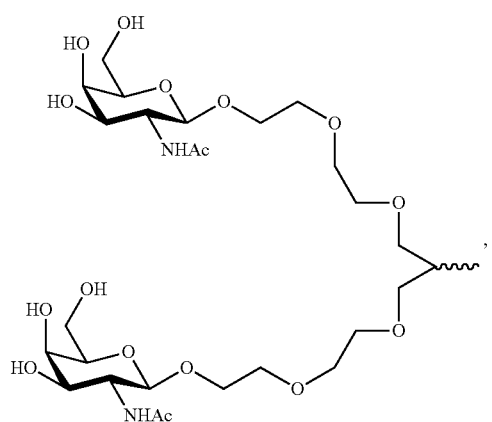

-continued
Formula VI
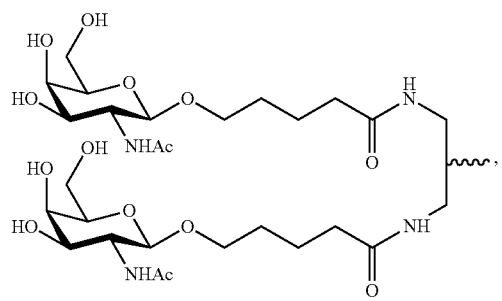
Formula VII
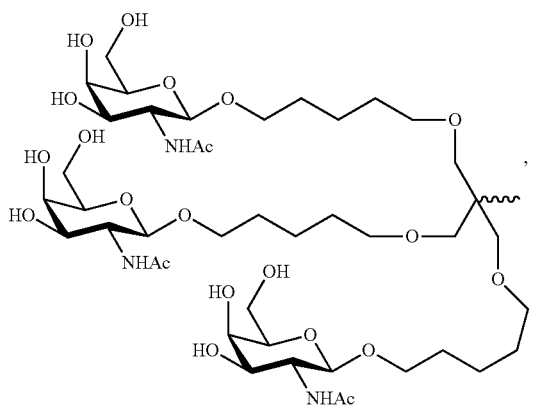
Formula VIII
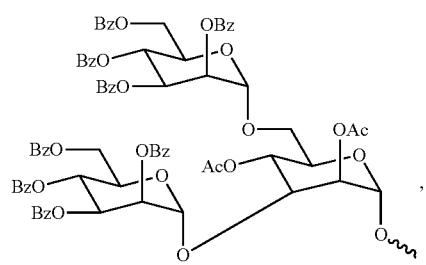
Formula IX
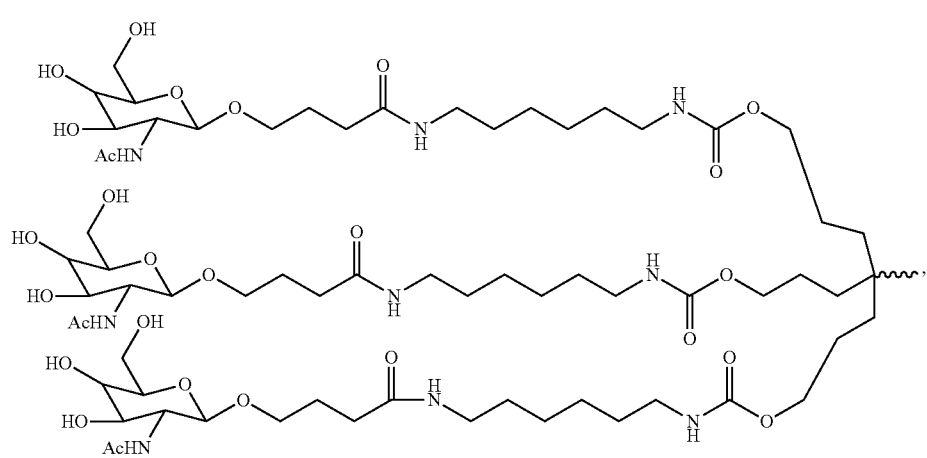

Formula X
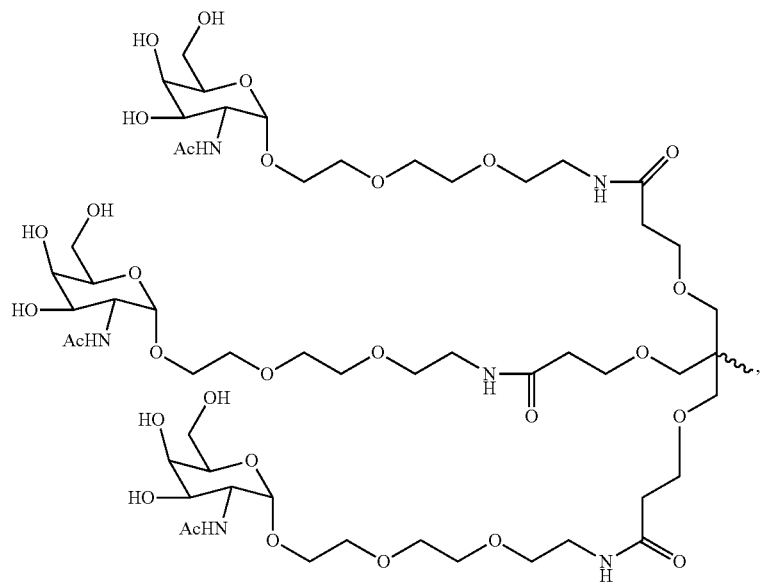
Formula XI
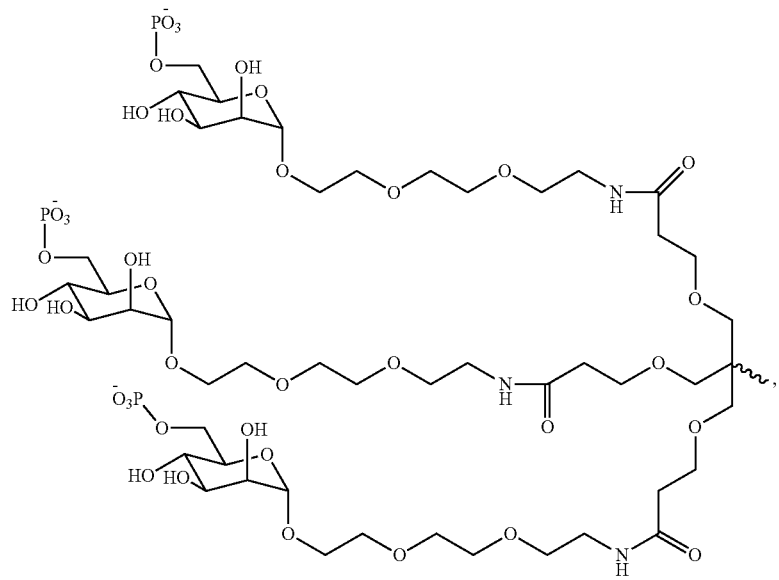

Formula XII
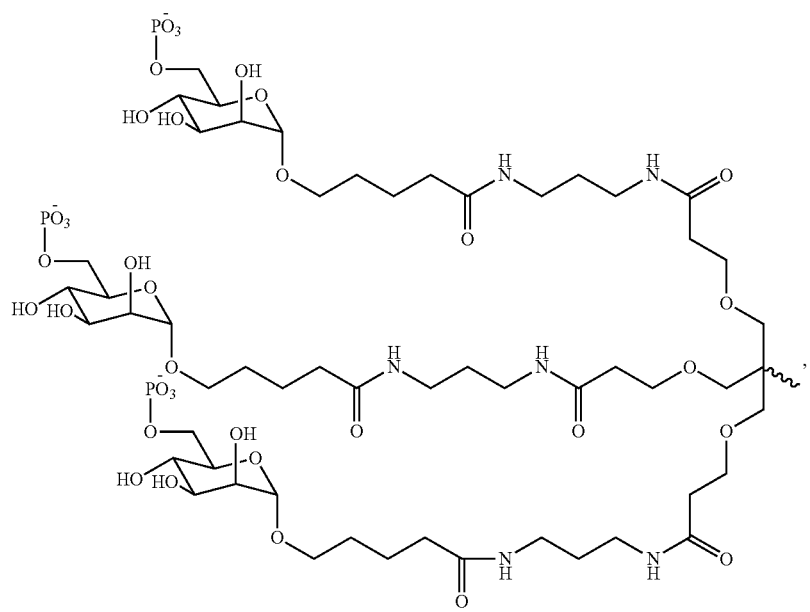
Formula XIII
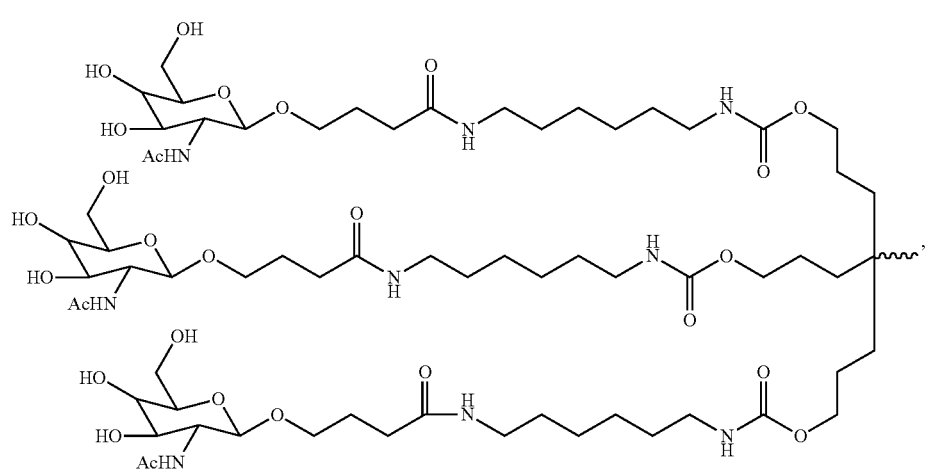
Formula XIV
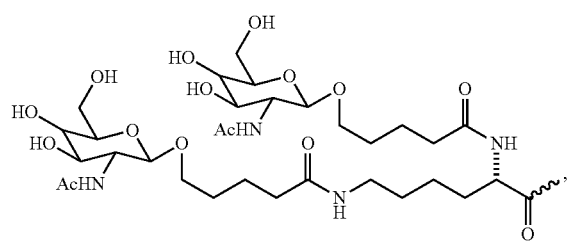
Formula XV
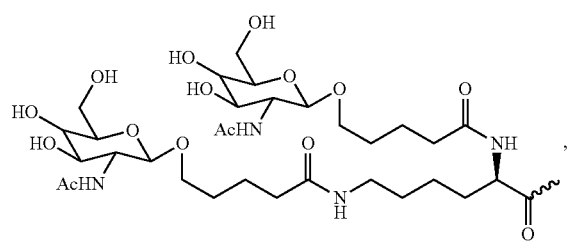
Formula XVI
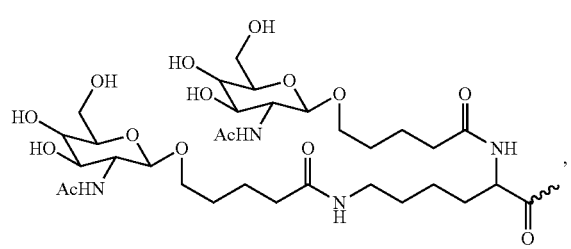
Formula XVII
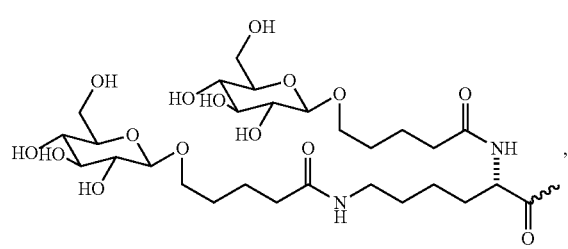

-continued
Formula XVIII
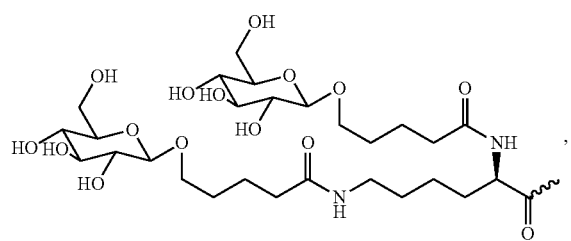
XX
Formula XIX
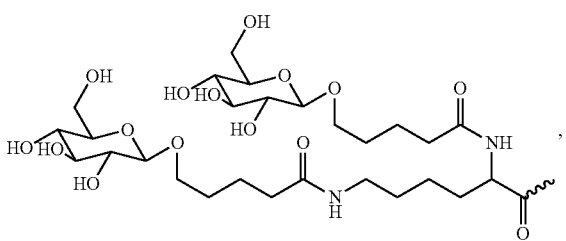
XXI
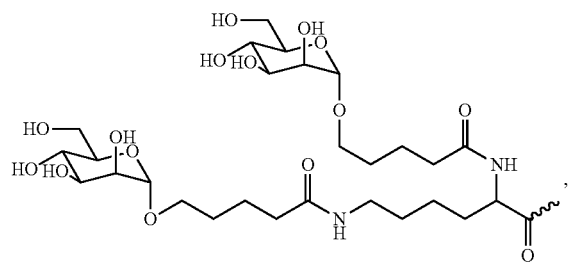
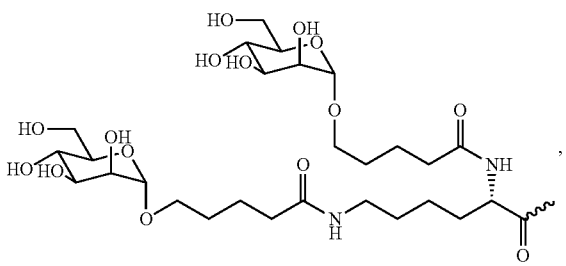
XXII
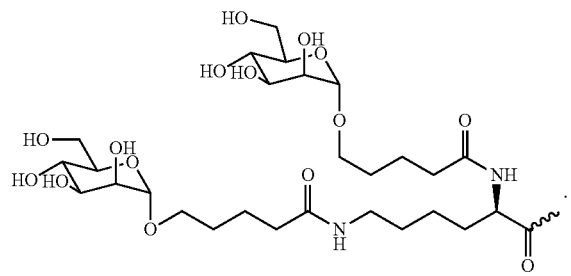
Another representative carbohydrate conjugate for use in the embodiments described herein includes, but is not limited to,

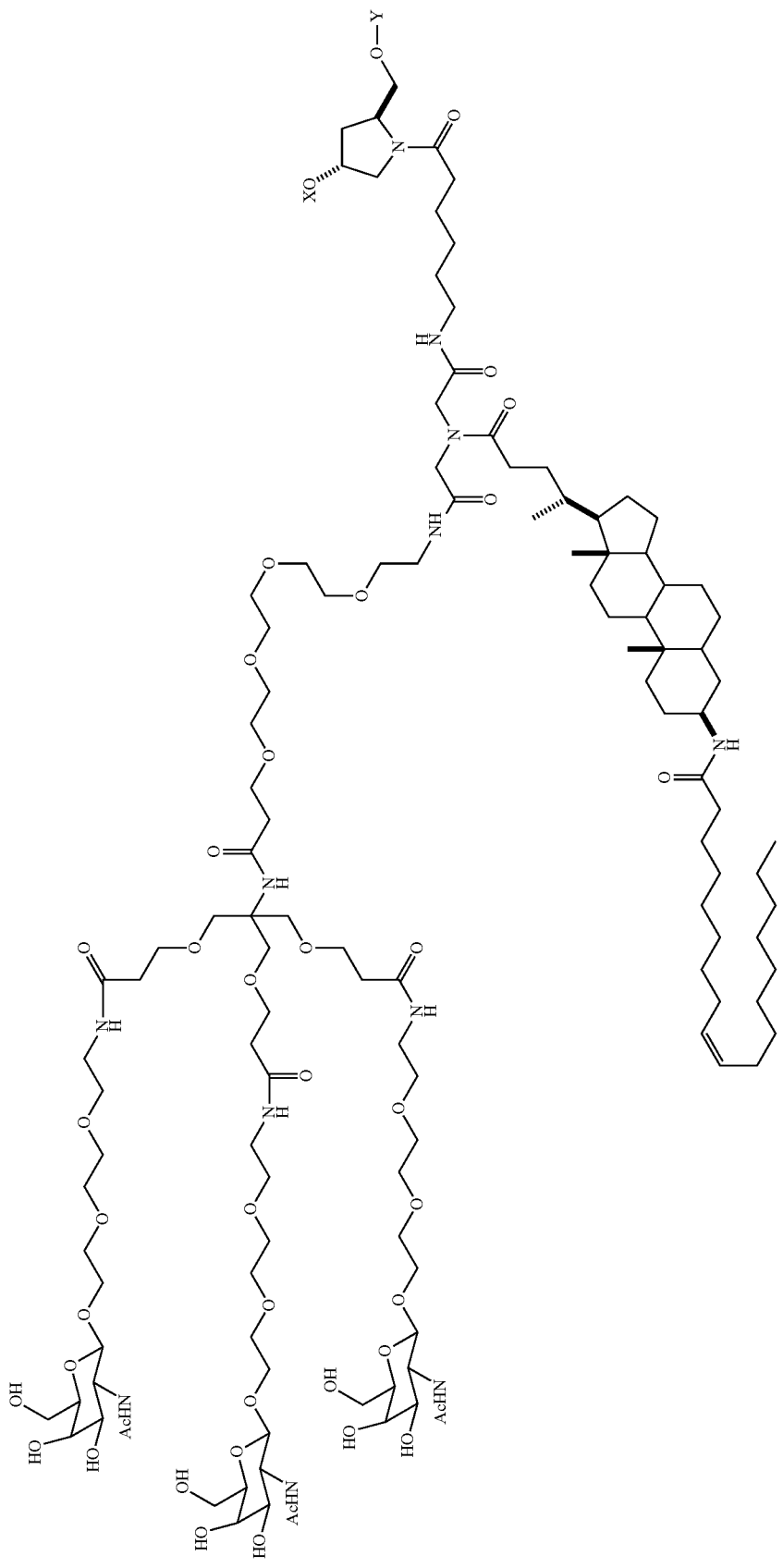

(Formula XXIII), when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

In some embodiments, the conjugate or ligand described herein can be attached to an dsRNA oligonucleotide with various linkers that can be cleavable or non cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular dsRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)— (SEQ ID NO: 13), where RA and RB are the R groups of the two adjacent amino acids. These candidates can be evaluated using methods analogous to those described above.

In one embodiment, an dsRNA of the invention is conjugated to a carbohydrate through a linker. Non-limiting examples of dsRNA carbohydrate conjugates with linkers of the compositions and methods of the invention include, but are not limited to, (Formula XXIV)

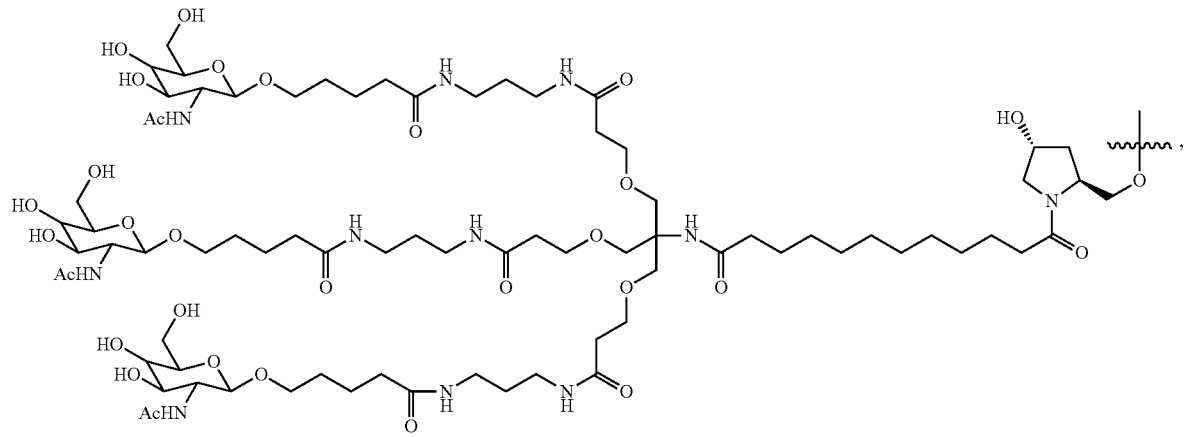

(Formula XXV)
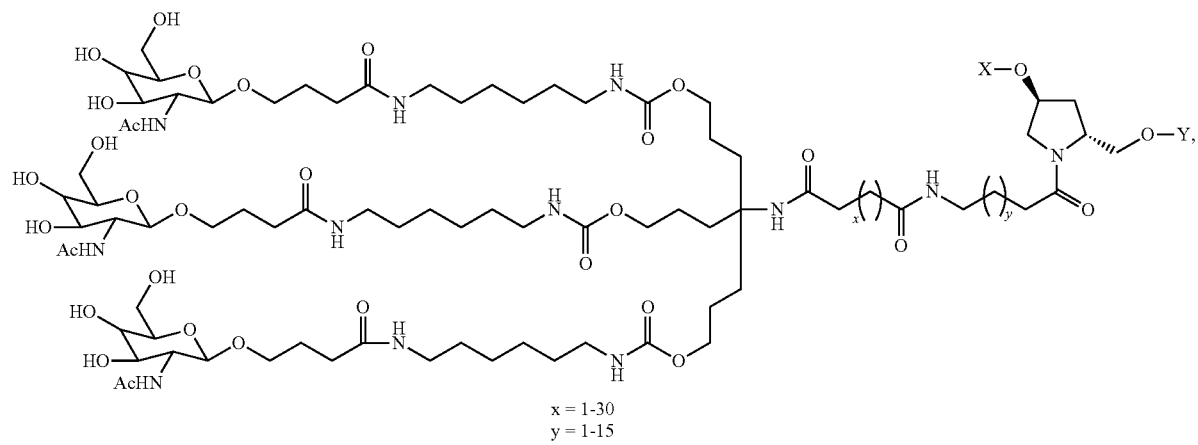
x = 1-30
y = 1-15
(Formula XXVI)
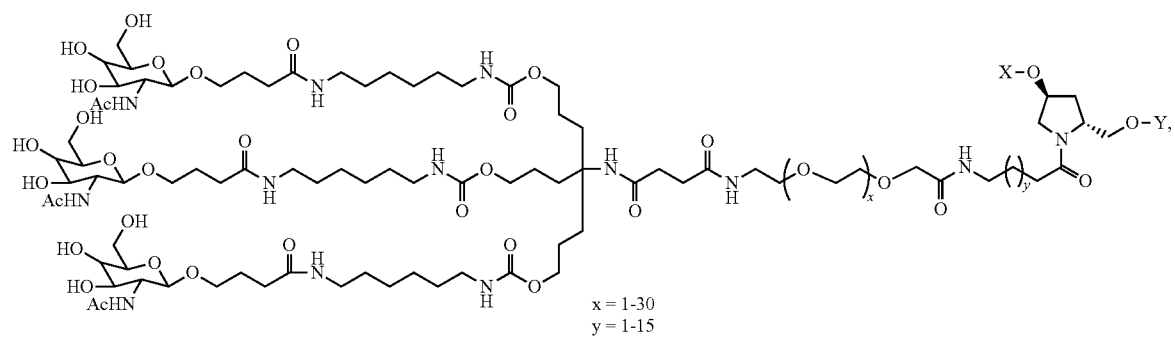
x = 1-30
y = 1-15
(Formula XXVII)
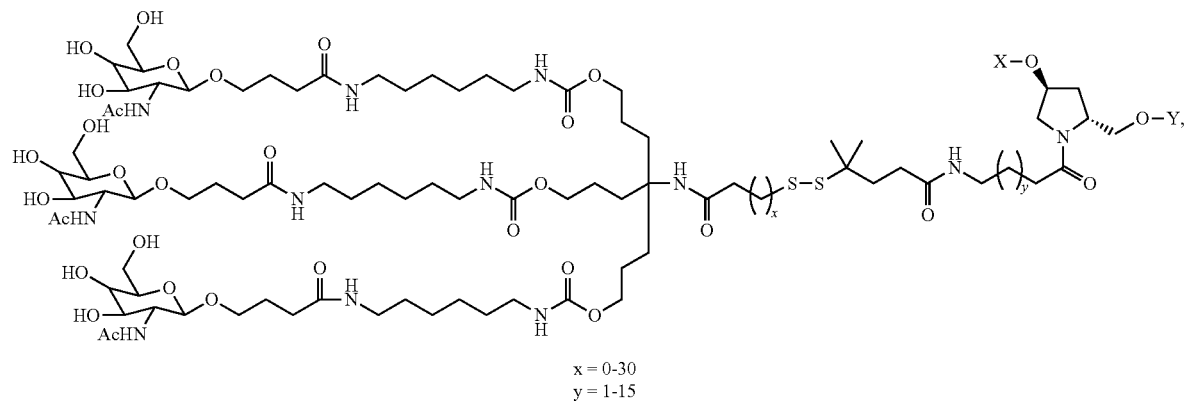
x = 0-30
y = 1-15

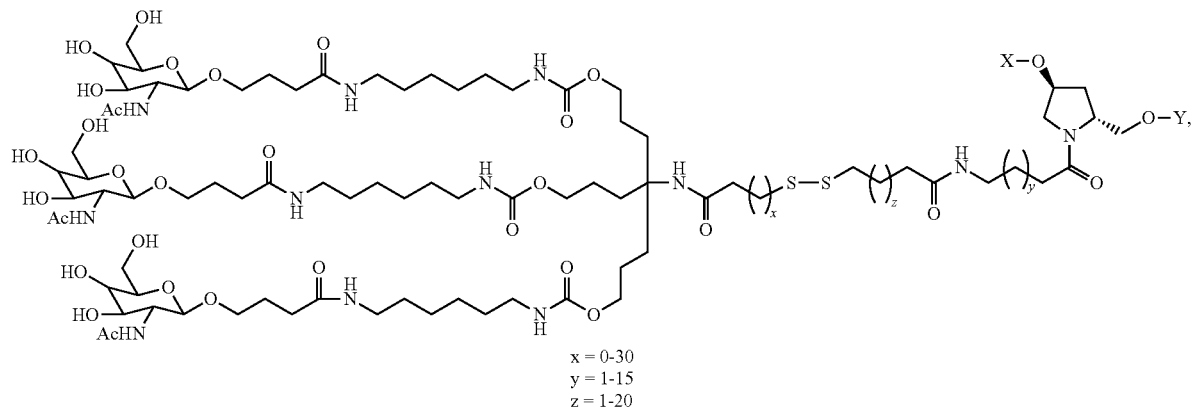
(Formula XXVIII)
x = 0-30
y = 1-15
z = 1-20
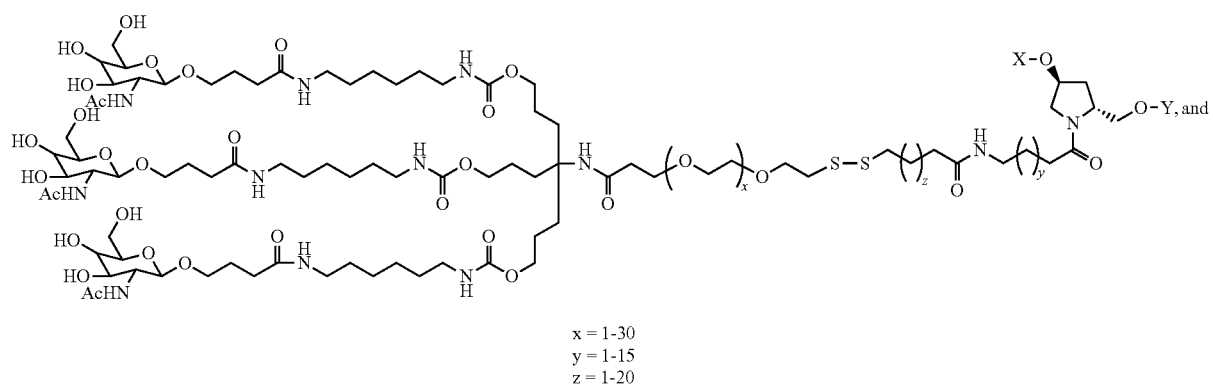
(Formula XXIX)
x = 1-30
y = 1-15
z = 1-20
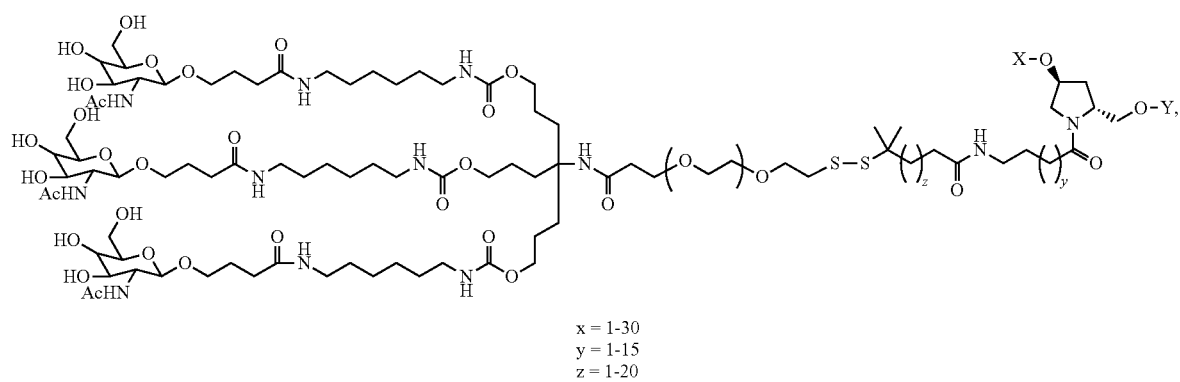
x = 1-30
y = 1-15
z = 1-20

(Formula XXX), when one of X or Y is an oligonucleotide, the other is a hydrogen.

In certain embodiments of the compositions and methods of the invention, a ligand is one or more GalNAc (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XXXI)-(XXXIV):

Formula XXXI

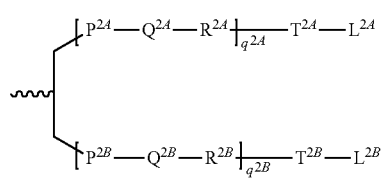
(IV)

Formula XXXII

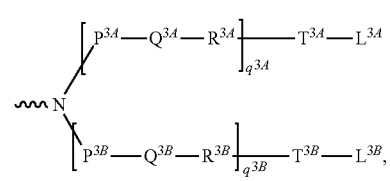
(V)

Formula XXXIII

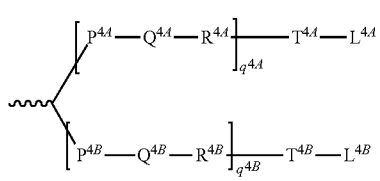

Formula XXXIV

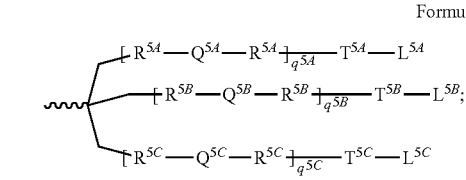

wherein:

q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4A}$, $T^{5B}$, $T^{5C}$ are each independently for each occurrence absent, CO, NH, O, S, OC(O), NHC(O), CH$_2$, CH$_2$NH or CH$_2$O;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

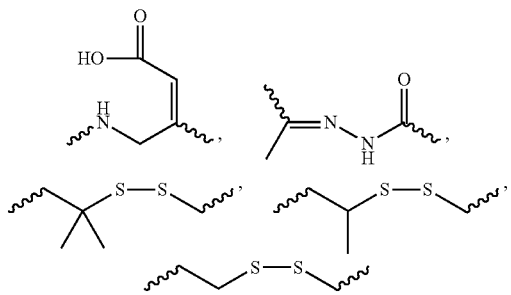

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XXXV):

Formula XXXV

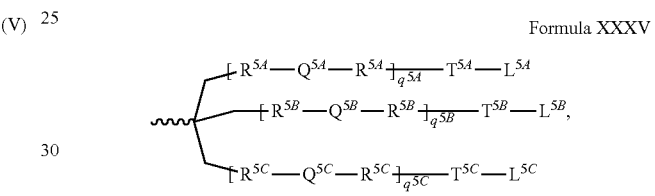

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications may be incorporated in a single compound or even at a single nucleoside within a dsRNA. The present invention also includes dsRNA compounds which are chimeric compounds. "Chimeric" dsRNA compounds or "chimeras," in the context of this invention, are dsRNA compounds, particularly dsRNAs, which contain two or more chemically distinct regions, each made up of at least one monomer unit, i.e., a nucleotide in the case of a dsRNA compound. These dsRNAs typically contain at least one region wherein the dsRNA is modified so as to confer upon the dsRNA increased resistance to nuclease degradation, increased cellular uptake, and/or increased binding affinity for the target nucleic acid. An additional region of the dsRNA may serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of dsRNA inhibition of gene expression. Consequently, comparable results can often be obtained with shorter dsRNAs when chimeric dsRNAs are used, compared to phosphorothioate deoxydsRNAs hybridizing to the same target region.

In certain instances, the dsRNA may be modified by a non-ligand group. A number of non-ligand molecules have been conjugated to dsRNAs in order to enhance the activity, cellular distribution or cellular uptake of the dsRNA, and procedures for performing such conjugations are available in the scientific literature. Such non-ligand moieties have included lipid moieties, such as cholesterol (Letsinger et al., Proc. Natl. Acad. Sci. USA, 1989, 86:6553), cholic acid (Manoharan et al., Bioorg. Med. Chem. Lett., 1994, 4:1053), a thioether, e.g., hexyl-S-tritylthiol (Manoharan et al., Ann. N.Y. Acad. Sci., 1992, 660:306: Manoharan et al., Bioorg. Med. Chem. Let., 1993, 3:2765), a thiocholesterol (Oberhauser et al., Nucl. Acids Res., 1992, 20:533), an aliphatic chain, e.g., dodecandiol or undecyl residues (Saison-Behmoaras et al., EMBO J., 1991, 10:111; Kabanov et al., FEBS Lett., 1990, 259:327; Svinarchuk et al., Biochimie, 1993, 75:49), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36:3651; Shea et al., Nucl. Acids Res., 1990, 18:3777), a polyamine or a polyethylene glycol chain (Manoharan et al., Nucleosides & Nucleotides, 1995, 14:969), or adamantane acetic acid (Manoharan et al., Tetrahedron Lett., 1995, 36:3651), a palmityl moiety (Mishra et al., Biochim. Biophys. Acta, 1995, 1264:229), or an octadecylamine or hexylamino-carbonyl-oxycholesterol moiety (Crooke et al., J. Pharmacol. Exp. Ther., 1996, 277:923). Representative United States patents that teach the preparation of such dsRNA conjugates have been listed above. Typical conjugation protocols involve the synthesis of dsRNAs bearing an aminolinker at one or more positions of the sequence. The amino group is then reacted with the molecule being conjugated using appropriate coupling or activating reagents. The conjugation reaction may be performed either with the dsRNA still bound to the solid support or following cleavage of the dsRNA in solution phase. Purification of the dsRNA conjugate by HPLC typically affords the pure conjugate.

Vector Encoded dsRNAs

In another aspect, HAMP, HFE2, HFE, TFR2, BMPR1a, SMAD4, IL6R, BMP6, and/or NEO1 dsRNA molecules are expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114,and Conrad, U.S. Pat. No. 6,054,299). These transgenes can be introduced as a linear construct, a circular plasmid, or a viral vector, which can be incorporated and inherited as a transgene integrated into the host genome. The transgene can also be constructed to permit it to be inherited as an extrachromosomal plasmid (Gassmann, et al., *Proc. Natl. Acad. Sci. USA* (1995) 92:1292).

The individual strands of a dsRNA can be transcribed by promoters on two separate expression vectors and co-transfected into a target cell. Alternatively each individual strand of the dsRNA can be transcribed by promoters both of which are located on the same expression plasmid. In one embodiment, a dsRNA is expressed as an inverted repeat joined by a linker polynucleotide sequence such that the dsRNA has a stem and loop structure.

The recombinant dsRNA expression vectors are generally DNA plasmids or viral vectors. dsRNA expressing viral vectors can be constructed based on, but not limited to, adeno-associated virus (for a review, see Muzyczka, et al., *Curr. Topics Micro. Immunol.* (1992) 158:97-129)); adenovirus (see, for example, Berkner, et al., BioTechniques (1998) 6:616), Rosenfeld et al. (1991, Science 252:431-434), and Rosenfeld et al. (1992), *Cell* 68:143-155)); or alphavirus as well as others known in the art. Retroviruses have been used to introduce a variety of genes into many different cell types, including epithelial cells, in vitro and/or in vivo (see, e.g., Eglitis, et al., *Science* (1985) 230:1395-1398; Danos and Mulligan, *Proc. Natl. Acad. Sci. USA* (1998) 85:6460-6464; Wilson et al., 1988, Proc. Natl. Acad. Sci. USA 85:3014-3018; Armentano et al., 1990, Proc. Natl. Acad. Sci. USA 87:61416145; Huber et al., 1991, Proc. Natl. Acad. Sci. USA 88:8039-8043; Ferry et al., 1991, Proc. Natl. Acad. Sci. USA 88:8377-8381; Chowdhury et al., 1991, Science 254:1802-1805; van Beusechem. et al., 1992, Proc. Natl. Acad. Sci. USA 89:7640-19; Kay et al., 1992, Human Gene Therapy 3:641-647; Dai et al., 1992, Proc. Natl. Acad. Sci. USA 89:10892-10895; Hwu et al., 1993, J. Immunol. 150:4104-4115; U.S. Pat. No. 4,868,116; U.S. Pat. No. 4,980,286; PCT Application WO 89/07136; PCT Application WO 89/02468; PCT Application WO 89/05345; and PCT Application WO 92/07573). Recombinant retroviral vectors capable of transducing and expressing genes inserted into the genome of a cell can be produced by transfecting the recombinant retroviral genome into suitable packaging cell lines such as PA317 and Psi-CRIP (Comette et al., 1991, Human Gene Therapy 2:5-10; Cone et al., 1984, Proc. Natl. Acad. Sci. USA 81:6349). Recombinant adenoviral vectors can be used to infect a wide variety of cells and tissues in susceptible hosts (e.g., rat, hamster, dog, and chimpanzee) (Hsu et al., 1992, J. Infectious Disease, 166:769), and also have the advantage of not requiring mitotically active cells for infection.

Any viral vector capable of accepting the coding sequences for the dsRNA molecule(s) to be expressed can be used, for example vectors derived from adenovirus (AV); adeno-associated virus (AAV); retroviruses (e.g., lentiviruses (LV), Rhabdoviruses, murine leukemia virus); herpes virus, and the like. The tropism of viral vectors can be modified by pseudotyping the vectors with envelope proteins or other surface antigens from other viruses, or by substituting different viral capsid proteins, as appropriate.

For example, lentiviral vectors featured in the invention can be pseudotyped with surface proteins from vesicular stomatitis virus (VSV), rabies, Ebola, Mokola, and the like. AAV vectors featured in the invention can be made to target different cells by engineering the vectors to express different capsid protein serotypes. For example, an AAV vector expressing a serotype 2 capsid on a serotype 2 genome is called AAV 2/2. This serotype 2 capsid gene in the AAV 2/2 vector can be replaced by a serotype 5 capsid gene to produce an AAV 2/5 vector. Techniques for constructing AAV vectors which express different capsid protein serotypes are within the skill in the art; see, e.g., Rabinowitz J E et al. (2002), J Virol 76:791-801, the entire disclosure of which is herein incorporated by reference.

Selection of recombinant viral vectors suitable for use in the invention, methods for inserting nucleic acid sequences for expressing the dsRNA into the vector, and methods of delivering the viral vector to the cells of interest are within the skill in the art. See, for example, Dornburg R (1995), Gene Therap. 2: 301-310; Eglitis M A (1988), Biotechniques 6: 608-614; Miller A D (1990), Hum Gene Therap. 1: 5-14; Anderson W F (1998), Nature 392: 25-30; and Rubinson D A et al., Nat. Genet. 33: 401-406, the entire disclosures of which are herein incorporated by reference.

Viral vectors can be derived from AV and AAV. In one embodiment, the dsRNA featured in the invention is expressed as two separate, complementary single-stranded RNA molecules from a recombinant AAV vector having, for example, either the U6 or H1 RNA promoters, or the cytomegalovirus (CMV) promoter.

A suitable AV vector for expressing the dsRNA featured in the invention, a method for constructing the recombinant AV vector, and a method for delivering the vector into target cells, are described in Xia H et al. (2002), *Nat. Biotech.* 20: 1006-1010.

Suitable AAV vectors for expressing the dsRNA featured in the invention, methods for constructing the recombinant AV vector, and methods for delivering the vectors into target cells are described in Samulski R et al. (1987), J. Virol. 61: 3096-3101; Fisher K J et al. (1996), J. Virol, 70: 520-532; Samulski R et al. (1989), J. Virol. 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

The promoter driving dsRNA expression in either a DNA plasmid or viral vector featured in the invention may be a eukaryotic RNA polymerase I (e.g., ribosomal RNA promoter), RNA polymerase II (e.g., CMV early promoter or actin promoter or U1 snRNA promoter) or generally RNA polymerase III promoter (e.g., U6 snRNA or 7SK RNA promoter) or a prokaryotic promoter, for example the T7 promoter, provided the expression plasmid also encodes T7 RNA polymerase required for transcription from a T7 promoter. The promoter can also direct transgene expression to the pancreas (see, e.g., the insulin regulatory sequence for pancreas (Bucchini et al., 1986, Proc. Natl. Acad. Sci. USA 83:2511-2515)).

In addition, expression of the transgene can be precisely regulated, for example, by using an inducible regulatory sequence and expression systems such as a regulatory sequence that is sensitive to certain physiological regulators, e.g., circulating glucose levels, or hormones (Docherty et al., 1994, FASEB J. 8:20-24). Such inducible expression systems, suitable for the control of transgene expression in cells or in mammals include regulation by ecdysone, by estrogen, progesterone, tetracycline, chemical inducers of dimerization, and isopropyl-beta-D1-thiogalactopyranoside (EPTG). A person skilled in the art would be able to choose the appropriate regulatory/promoter sequence based on the intended use of the dsRNA transgene.

Generally, recombinant vectors capable of expressing dsRNA molecules are delivered as described below, and persist in target cells. Alternatively, viral vectors can be used that provide for transient expression of dsRNA molecules. Such vectors can be repeatedly administered as necessary. Once expressed, the dsRNAs bind to target RNA and modulate its function or expression. Delivery of dsRNA expressing vectors can be systemic, such as by intravenous or intramuscular administration, by administration to target cells ex-planted from the patient followed by reintroduction into the patient, or by any other means that allows for introduction into a desired target cell.

dsRNA expression DNA plasmids are typically transfected into target cells as a complex with cationic lipid carriers (e.g., Oligofectamine) or non-cationic lipid-based carriers (e.g., Transit-TKO™). Multiple lipid transfections for dsRNA-mediated knockdowns targeting different regions of a single HAMP, HFE2, HFE, TFR2. BMPR1a, SMAD4, IL6R. BMP6, and/or NEO1 gene or multiple HAMP, HFE2, HFE, TFR2, BMPR1a, SMAD4, IL6R, BMP6, and/or NEO1 genes over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

HAMP, HFE2, HFE, TFR2, BMPR1a, SMAD4, IL6R, BMP6, and/or NEO1 specific dsRNA molecules can also be inserted into vectors and used as gene therapy vectors for human patients. Gene therapy vectors can be delivered to a subject by, for example, intravenous injection, local administration (see U.S. Pat. No. 5,328,470) or by stereotactic injection (see e.g., Chen et al. (1994) Proc. Natl. Acad. Sci. USA 91:3054-3057). The pharmaceutical preparation of the gene therapy vector can include the gene therapy vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmaceutical Compositions Containing dsRNA

In one embodiment, the invention provides pharmaceutical compositions containing a dsRNA, as described herein, and a pharmaceutically acceptable carrier. The pharmaceutical composition containing the dsRNA is useful for treating a disease or disorder associated with the expression or activity of a HAMP, HFE2, HFE, TFR2, BMPR1a, SMAD4, IL6R, BMP6, and/or NEO1 gene, such as pathological processes mediated by HAMP, HFE2, HFE, TFR2, BMPR1a, SMAD4, IL6R, BMP6, and/or NEO1 expression. Such pharmaceutical compositions are formulated based on the mode of delivery. One example is compositions that are formulated for systemic administration via parenteral delivery, e.g., by intravenous (IV) delivery. Another example is compositions that are formulated for direct delivery into the brain parenchyma, e.g., by infusion into the brain, such as by continuous pump infusion.

The pharmaceutical compositions featured herein are administered in dosages sufficient to inhibit expression of HAMP, HFE2, HFE, TFR2, BMPR1a, SMAD4, IL6R, BMP6, and/or NEO1 genes.

In general, a suitable dose of dsRNA will be in the range of 0.01 to 200.0 milligrams per kilogram body weight of the recipient per day, generally in the range of 1 to 50 mg per kilogram body weight per day. For example, the dsRNA can be administered at 0.0059 mg/kg, 0.01 mg/kg, 0.0295 mg/kg, 0.05 mg/kg, 0.0590 mg/kg, 0.163 mg/kg, 0.2 mg/kg, 0.3 mg/kg, 0.4 mg/kg, 0.5 mg/kg, 0.543 mg/kg, 0.5900 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, 1.5 mg/kg, 1.628 mg kg, 2 mg/kg, 3 mg/kg, 5.0 mg/kg, 10 mg/kg, 20 mg/kg, 30 mg/kg, 40 mg/kg, or 50 mg/kg per single dose.

In one embodiment, the dosage is between 0.01 and 0.2 mg/kg. For example, the dsRNA can be administered at a dose of 0.01 mg/kg, 0.02 mg/kg, 0.03 mg/kg, 0.04 mg/kg, 0.05 mg/kg, 0.06 mg/kg, 0.07 mg/kg 0.08 mg/kg 0.09 mg/kg, 0.10 mg/kg, 0.11 mg/kg, 0.12 mg/kg, 0.13 mg/kg, 0.14 mg kg, 0.15 mg/kg, 0.16 mg/kg, 0.17 mg/kg, 0.18 mg/kg, 0.19 mg kg, or 0.20 mg/kg.

In one embodiment, the dosage is between 0.005 mg/kg and 1.628 mg/kg. For example, the dsRNA can be administered at a dose of 0.0059 mg/kg, 0.0295 mg/kg, 0.0590 mg/kg, 0.163 mg/kg, 0.543 mg/kg, 0.5900 mg/kg, or 1.628 mg/kg.

In one embodiment, the dosage is between 0.2 mg/kg and 1.5 mg kg. For example, the dsRNA can be administered at a dose of 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, 1.1 mg/kg, 1.2 mg/kg, 1.3 mg/kg, 1.4 mg/kg, or 1.5 mg/kg.

The dsRNA can be administered at a dose of 0.03 mg/kg, or 0.03, 0.1, 0.2, or 0.4 mg/kg.

The pharmaceutical composition may be administered once daily or the dsRNA may be administered as two, three, or more sub-doses at appropriate intervals throughout the day or even using continuous infusion or delivery through a controlled release formulation. In that case, the dsRNA contained in each sub-dose must be correspondingly smaller in order to achieve the total daily dosage. The dosage unit can also be compounded for delivery over several days, e.g., using a conventional sustained release formulation which provides sustained release of the dsRNA over a several day period. Sustained release formulations are well known in the art and are particularly useful for delivery of agents at a particular site, such as could be used with the agents of the present invention. In this embodiment, the dosage unit contains a corresponding multiple of the daily dose.

The effect of a single dose on HAMP, HFE2, HFE, TFR2, BMPR1a, SMAD4, IL6R, BMP6, and/or NEO1 levels is long lasting, such that subsequent doses are administered at not more than 3, 4, or 5 day intervals, or at not more than 1, 2, 3, or 4 week intervals, or at not more than 5, 6, 7, 8, 9, or 10 week intervals.

The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual dsRNAs encompassed by the invention can be made using conventional methodologies or on the basis of in vivo testing using an appropriate animal model, as described elsewhere herein.

Advances in mouse genetics have generated a number of mouse models for the study of various human diseases, such as pathological processes mediated by HAMP, HFE2, HFE, TFR2, BMPR1a, SMAD4, IL6R, BMP6, and/or NEO1 expression. Such models are used for in vivo testing of dsRNA, as well as for determining a therapeutically effective dose. A suitable mouse model is, for example, a mouse containing a plasmid expressing human HAMP, HFE2, HFE, TFR2, BMPR1a, SMAD4, IL6R, BMP6, and/or NEO1. Another suitable mouse model is a transgenic mouse carrying a transgene that expresses human HAMP, HFE2, HFE, TFR2, BMPR1a, SMAD4, IL6R, BMP6, and/or NEO1.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

The dsRNAs featured in the invention can be administered in combination with other known agents effective in treatment of pathological processes mediated by target gene expression. In any event, the administering physician can adjust the amount and timing of dsRNA administration on the basis of results observed using standard measures of efficacy known in the art or described herein.

Administration

The present invention also includes pharmaceutical compositions and formulations which include the dsRNA compounds featured in the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer, intratracheal, intranasal, epidermal and transdermal, oral or parenteral. Parenteral administration includes intravenous, intraarterial, subcutaneous, intraperitoneal or intramuscular injection or infusion; or intracranial, e.g., intraparenchymal, intrathecal or intraventricular, administration.

The dsRNA can be delivered in a manner to target a particular tissue.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Suitable topical formulations include those in which the dsRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearoylphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). DsRNAs featured in the invention may be encapsulated within liposomes or may form complexes thereto, in particular to cationic liposomes. Alternatively, dsRNAs may be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-10}$ alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

Liposomal Formulations

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell wall, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Several studies have assessed the topical delivery of liposomal drug formulations to the skin. Application of liposomes containing interferon to guinea pig skin resulted in a reduction of skin herpes sores while delivery of interferon via other means (e.g., as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S.T.P.Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_{M1}$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B 1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include a dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g. they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Nucleic Acid Lipid Particles

In one embodiment, a HAMP, HFE2, HFE, TFR2, BMPR1a, SMAD4, IL6R, BMP6, and/or NEO1 dsRNA featured in the invention is fully encapsulated in the lipid formulation, e.g., a nucleic acid lipid particle, e.g., SPLP, pSPLP, SNALP, or other nucleic acid-lipid particle. As used herein, the term "SNALP" refers to a stable nucleic acid-lipid particle, including SPLP. As used herein, the term "SPLP" refers to a nucleic acid-lipid particle comprising plasmid DNA encapsulated within a lipid vesicle. SPLPs include "pSPLP," which include an encapsulated condensing agent-nucleic acid complex as set forth in PCT Publication No. WO 00/03683. Nucleic acid lipid particles typically contain a cationic lipid, a non-cationic lipid, and a lipid that prevents aggregation of the particle (e.g., a PEG-lipid conjugate). Nucleic acid lipid particles are extremely useful for systemic applications, as they exhibit extended circulation lifetimes following intravenous (i.v.) injection and accumulate at distal sites (e.g., sites physically separated from the administration site).

The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. In some embodiments the lipid to dsRNA ratio can be about 1:1, 2:1, 3:1, 4:1, 5:1, 6:1, 7:1, 8:1, 9:1, 10:1, or 11:1.

In general, the lipid-nucleic acid particle is suspended in a buffer, e.g., PBS, for administration. In one embodiment, the pH of the lipid formulated siRNA is between 6.8 and 7.8, e.g., 7.3 or 7.4. The osmolality can be, e.g., between 250 and 350 mOsm/kg, e.g., around 300, e.g., 298, 299, 300, 301, 302, 303, 304, or 305.

The cationic lipid may be, for example, N,N-dioleyl-N,N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200 or Tech G1), or a mixture thereof. The cationic lipid may comprise from about 20 mol % to about 50 mol % or about 40 mol % of the total lipid present in the particle.

The non-cationic lipid may be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid may be from about 5 mol % to about 90 mol %, about 10 mol %, or about 58 mol % if cholesterol is included, of the total lipid present in the particle.

The conjugated lipid that inhibits aggregation of particles may be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate may be, for example, a PEG-dilauryloxypropyl ($Ci_2$), a PEG-dimyristyloxypropyl ($Ci_4$), a PEG-dipalmityloxypropyl ($Cl_6$), or a PEG-distearyloxypropyl ($C_{18}$). Other examples of PEG conjugates include PEG-cDMA (N-[(methoxy poly(ethylene glycol)2000)carbamyl]-1,2-dimyristyloxlpropyl-3-amine), mPEG2000-DMG (mPEG-dimyrystylglycerol (with an average molecular weight of 2,000) and PEG-C-DOMG (R-3-[(ω-methoxy-poly(ethylene glycol) 2000)carbamoyl)]-1,2-dimyristyloxlpropyl-3-amine). The conjugated lipid that prevents aggregation of particles may be from 0 mol % to about 20 mol % or about 1.0, 1.1, 1.2, 1.3, 1.4, 1.5, 1.6, 1.7, 1.8, 1.9, or 2 mol % of the total lipid present in the particle.

In some embodiments, the nucleic acid-lipid particle further includes cholesterol at, e.g., about 10 mol % to about 60 mol % or about 45, 46, 47, 48, 49, 50, 51, 52, 53, 54, or 55 mol % of the total lipid present in the particle.

LNP01

LNP01 formulations are described, e.g., in International Application Publication No. WO 2008/042973, which is hereby incorporated by reference.

Additional exemplary formulations are described in Table A.

TABLE A

| | Cationic Lipid | cationic lipid/non-cationic lipid/cholesterol/PEG-lipid conjugate Mol % ratios Lipid:siRNA ratio |
|---|---|---|
| SNALP | DLinDMA | DLinDMA/DPPC/Cholesterol/PEG-cDMA (57.1/7.1/34.4/1.4) lipid:siRNA ~7:1 |
| S-XTC | XTC | XTC/DPPC/Cholesterol/PEG-cDMA 57.1/7.1/34.4/1.4 lipid:siRNA ~7:1 |
| LNP05 | XTC | XTC/DSPC/Cholesterol/PEG-DMG 57.5/7.5/31.5/3.5 lipid:siRNA ~6:1 |
| LNP06 | XTC | XTC/DSPC/Cholesterol/PEG-DMG 57.5/7.5/31.5/3.5 lipid:siRNA ~11:1 |
| LNP07 | XTC | XTC/DSPC/Cholesterol/PEG-DMG 60/7.5/31/1.5, lipid:siRNA ~6:1 |
| LNP08 | XTC | XTC/DSPC/Cholesterol/PEG-DMG 60/7.5/31/1.5, lipid:siRNA ~11:1 |
| LNP09 | XTC | XTC/DSPC/Cholesterol/PEG-DMG 50/10/38.5/1.5 Lipid:siRNA 10:1 |
| LNP10 | ALN100 | ALN100/DSPC/Cholesterol/PEG-DMG 50/10/38.5/1.5 Lipid:siRNA 10:1 |

TABLE A-continued

| | Cationic Lipid | cationic lipid/non-cationic lipid/cholesterol/PEG-lipid conjugate Mol % ratios<br>Lipid:siRNA ratio |
|---|---|---|
| LNP11 | MC3 | MC-3/DSPC/Cholesterol/PEG-DMG<br>50/10/38.5/1.5<br>Lipid:siRNA 10:1 |
| LNP12 | C12-200 | C12-200/DSPC/Cholesterol/PEG-DMG<br>50/10/38.5/1.5<br>Lipid:siRNA 10:1 |
| LNP13 | XTC | XTC/DSPC/Chol/PEG-DMG<br>50/10/38.5/1.5<br>Lipid:siRNA: 33:1 |
| LNP14 | MC3 | MC3/DSPC/Chol/PEG-DMG<br>40/15/40/5<br>Lipid:siRNA: 11:1 |
| LNP15 | MC3 | MC3/DSPC/Chol/PEG-DSG/GalNAc-PEG-DSG<br>50/10/35/4.5/0.5<br>Lipid:siRNA: 11:1 |
| LNP16 | MC3 | MC3/DSPC/Chol/PEG-DMG<br>50/10/38.5/1.5<br>Lipid:siRNA: 7:1 |
| LNP17 | MC3 | MC3/DSPC/Chol/PEG-DSG<br>50/10/38.5/1.5<br>Lipid:siRNA: 10:1 |
| LNP18 | MC3 | MC3/DSPC/Chol/PEG-DMG<br>50/10/38.5/1.5<br>Lipid:siRNA: 12:1 |
| LNP19 | MC3 | MC3/DSPC/Chol/PEG-DMG<br>50/10/35/5<br>Lipid:siRNA: 8:1 |
| LNP20 | MC3 | MC3/DSPC/Chol/PEG-DPG<br>50/10/38.5/1.5<br>Lipid:siRNA: 10:1 |
| LNP21 | C12-200 | C12-200/DSPC/Chol/PEG-DSG<br>50/10/38.5/1.5<br>Lipid:siRNA: 7:1 |
| LNP22 | XTC | XTC/DSPC/Chol/PEG-DSG<br>50/10/38.5/1.5<br>Lipid:siRNA: 10:1 |

SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.

XTC (2,2-Dilinoleyl-4-dimethylaminoethyl-[1,3]-dioxolane) comprising formulations are described, e.g., in U.S. Provisional Ser. No. 61/148,366, filed Jan. 29, 2009; U.S. Provisional Ser. No. 61/156,851, filed Mar. 2, 2009; U.S. Provisional Ser. No. filed Jun. 10, 2009; U.S. Provisional Ser. No. 61/228,373, filed Jul. 24, 2009; U.S. Provisional Ser. No. 61/239,686, filed Sep. 3, 2009, and International Application No. PCT/US2010/022614, filed Jan. 29, 2010, which are hereby incorporated by reference.

MC3 ((6Z,9Z,28Z,31Z)-heptatriaconta-6,9,28,31-tetraen-19-yl 4-(dimethylamino)butanoate), (e.g., DLin-M-C3-DMA) comprising formulations are described, e.g., in U.S. Provisional Ser. No. 61/244,834, filed Sep. 22, 2009, U.S. Provisional Ser. No. 61/185,800, filed Jun. 10, 2009, and International Application No. PCT/US10/28224, filed Jun. 10, 2010, which are hereby incorporated by reference.

ALNY-100 ((3aR,5s,6aS)-N,N-dimethyl-2,2-di((9Z,12Z)-octadeca-9,12-dienyl)tetrahydro-3aH-cyclopenta[d][1,3]dioxol-5-amine) comprising formulations are described, e.g., International patent application number PCT/US09/63933, filed on Nov. 10, 2009, which is hereby incorporated by reference.

C12-200, i.e., Tech G1, comprising formulations are described in U.S. Provisional Ser. No. 61/175,770, filed May 5, 2009 and International Application No. PCT/US10/33777, filed May 5, 2010, which are hereby incorporated by reference.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total siRNA concentration in the formulation, as well as the entrapped fraction, is estimated using a dye exclusion assay. A sample of the formulated siRNA can be incubated with an RNA-binding dye, such as Ribogreen (Molecular Probes) in the presence or absence of a formulation disrupting surfactant, e.g., 0.5% Triton-X100. The total siRNA in the formulation can be determined by the signal from the sample containing the surfactant, relative to a standard curve. The entrapped fraction is determined by subtracting the "free" siRNA content (as measured by the signal in the absence of surfactant) from the total siRNA content. Percent entrapped siRNA is typically >85%. For a nucleic acid lipid formulation, the particle size is at least 30 nm, at least 40 nm, at least 50 nm, at least 60 nm, at least70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. In some embodiments, oral formulations are those in which dsRNAs featured in the invention are administered in conjunction with one or more penetration enhancers surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acyl-camitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

Emulsions

The compositions of the present invention may be prepared and formulated as emulsions. Emulsions are typically heterogeneous systems of one liquid dispersed in another in the form of droplets usually exceeding 0.1 µm in diameter (Idson, in Pharmaceutical Dosage Forms, Lieberman, Rieger and Banker (Eds.), 1988, Marcel Dekker, Inc., New York, N.Y., volume 1, p. 199: Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335, Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., Critical Reviews in Therapeutic Drug Carrier Systems, 1991, page 92: Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Other Components

The compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and/or dextran. The suspension may also contain stabilizers.

In some embodiments, pharmaceutical compositions featured in the invention include (a) one or more dsRNA compounds and (b) one or more anti-cytokine biologic agents which function by a non-RNAi mechanism. Examples of such biologics include, biologics that target IL1β (e.g., anakinra), IL6 (tocilizumab), or TNF (etanercept, infliximab, adlimumab, or certolizumab).

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage may vary within this range depending upon the dosage form employed and the route of administration utilized. For any compound used in the methods featured in the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration, as discussed above, the dsRNAs featured in the invention can be administered in combination with other known agents effective in treatment of pathological processes mediated by HAMP, HFE2, HFE, TFR2, BMPR1a, SMAD4, IL6R, BMP6, and/or NEO1 expression. In any event, the administering physician can adjust the amount and timing of dsRNA administration on the basis of results observed using standard measures of efficacy known in the art or described herein.

Methods for Inhibiting Expression of a HAMP, HFE2, HFE, TFR2. BMPR1a, SMAD4, IL6R, BMP6, and/or NEO1 Gene In yet another aspect, the invention provides a method for inhibiting the expression of a HAMP, HFE2, HFE, TFR2, BMPR1a, SMAD4, IL6R, BMP6, and/or NEO1 gene in a mammal. The method includes administering a composition featured in the invention to the mammal such that expression of the target HAMP, HFE2, HFE, TFR2, BMPR1a, SMAD4, IL6R, BMP6, and/or NEO1 gene is silenced.

When the organism to be treated is a mammal such as a human, the composition may be administered by any means known in the art including, but not limited to oral or parenteral routes, including intracranial (e.g., intraventricular, intraparenchymal and intrathecal), intravenous, intramuscular, subcutaneous, transdermal, airway (aerosol), nasal, rectal, and topical (including buccal and sublingual) administration. In certain embodiments, the compositions are administered by intravenous infusion or injection.

Methods for Treating Diseases Caused by Expression of a HAMP, HFE2, HFE, TFR2,BMPR1a, SMAD4, IL6R, BMP6, and/or NEO1 Gene The invention relates in particular to the use of a dsRNA targeting HAMP, HFE2, HFE, TFR2, BMPR1a, SMAD4, IL6R, BMP6, and/or NEO1 and compositions containing at least one such dsRNA for the treatment of a HAMP, HFE2, HFE, TFR2, BMPR1a, SMAD4, IL6R, BMP6, and/or NEO1-mediated disorder or disease. For example, the compositions described herein can be used to treat anemia and other diseases associated with lowered iron levels.

Methods of Using dsRNAs Targeting HAMP, HFE2, HFE, TFR2, BMPR1a, SMAD4, IL6R, BMP6, and/or NEO1

In one aspect, the invention provides use of a siRNA for inhibiting the expression of HAMP, HFE2, HFE, TFR2, BMPR1a, SMAD4, IL6R, BMP6, and/or NEO1 in a mammal. The method includes administering a composition of the invention to the mammal such that expression of the target HAMP, HFE2, HFE, TFR2, BMPR1a, SMAD4, IL6R, BMP6, and/or NEO1 gene is decreased. In some embodiments, HAMP, HFE2, HFE, TFR2, BMPR1a, SMAD4, IL6R. BMP6, and/or NEO1 expression is decreased for an extended duration, e.g., at least one week, two weeks, three weeks, or four weeks or longer. For example, in certain instances, expression of the HAMP, HFE2, HFE, TFR2, BMPR1a, SMAD4, IL6R, BMP6, and/or NEO1 gene is suppressed by at least about 5%, 10%, 15%, 20%, 25%, 30%, 35%, 40%, 45%, or 50% by administration of a siRNA described herein. In some embodiments, the HAMP, HFE2, HFE, TFR2, BMPR1a, SMAD4, IL6R, BMP6, and/or NEO1 gene is suppressed by at least about 60%, 70%, or 80% by administration of the siRNA. In some embodiments, the HAMP, HFE2, HFE, TFR2, BMPR1a, SMAD4, IL6R, BMP6, and/or NEO1 gene is suppressed by at least about 85%, 90%, or 95% by administration of the double-stranded oligonucleotide.

The methods and compositions described herein can be used to treat diseases and conditions that can be modulated by down regulating HAMP, HFE2, HFE, TFR2, BMPR1a, SMAD4, IL6R, BMP6, and/or NEO1 gene expression. For example, the compositions described herein can be used to treat anemia and other forms of iron imbalance such as refractory anemia, refractory anemia of chronic disease (ACD), iron-restricted erythropoiesis, and the pathological conditions associated with these disorders. In some aspects, ACD subjects are those who are refractory to ESAs and i.v. iron administration. In some embodiments, the method includes administering an effective amount of a siRNA disclosed herein to a patient having lower iron levels relative to a control patient.

Therefore, the invention also relates to the use of a siRNA for the treatment of a disorder or disease mediated by or related to HAMP, HFE2, HFE, TFR2, BMPR1a, SMAD4, IL6R, BMP6, and/or NEO1 gene expression. For example, a siRNA is used for treatment of anemia.

The effect of the decreased HAMP, HFE2, HFE, TFR2, BMPR1a, SMAD4, IL6R, BMP6, and/or NEO1 gene expression preferably results in an enhancement of iron mobilization in the mammal. In some embodiments, iron mobilization is enhanced by at least 10%, 15%, 20%, 25%, 30%, 40%, 50%, or 60%, or more, as compared to pretreatment levels.

The effect of the decreased HAMP, HFE2, HFE, TFR2, BMPR1a, SMAD4, IL6R, BMP6, and/or NEO1 gene expression preferably results in an Hb increase in the mammal. In some embodiments, Hb is increased by at least 10%, 15%, 20%, 25%, 30%, 40%, 50%, or 60%, or more, as compared to pretreatment levels.

The effect of the decreased HAMP, HFE2, HFE, TFR2, BMPR1a, SMAD4, IL6R, BMP6, and/or NEO1 gene expression preferably results in a serum iron increase in the mammal. In some embodiments, serum iron is increased by at least 10%, 15%, 20%, 25%, 30%, 40%, 50%, or 60%, or more, as compared to pretreatment levels.

The effect of the decreased HAMP, HFE2, HFE, TFR2, BMPR1a, SMAD4, IL6R, BMP6, and/or NEO1 gene expression preferably results in a transderrin (Tf) saturation increase in the mammal. In some embodiments, Tf saturation is increased by at least 10%, 15%, 20%, 25%, 30%, 40%, 50%, or 60%, or more, as compared to pretreatment levels.

The effect of the decreased HAMP, HFE2, HFE, TFR2, BMPR1a, SMAD4, IL6R, BMP6, and/or NEO1 gene expression preferably results in decreased levels of HAMP in the mammal. In some embodiments, HAMP is decreased by at least 10%, 15%, 20%, 25%, 30%, 40%, 50%, or 60%, or more, as compared to pretreatment levels.

The method includes administering a siRNA to the subject to be treated. The subject to be treated is generally a subject in need thereof. When the subject to be treated is a mammal, such as a human, the composition can be administered by any means known in the art including, but not limited to oral or parenteral routes, including intravenous, intramuscular, subcutaneous, transdermal, and airway (aerosol) administration. In some embodiments, the compositions are administered by intravenous infusion or injection.

The method includes administering a siRNA, e.g., a dose sufficient to depress levels of HAMP, HFE2, HFE, TFR2, BMPR1a, SMAD4, IL6R, BMP6, and/or NEO1 mRNA for at least5, more preferably 7, 10, 14, 21, 25, 30 or 40 days; and optionally, administering a second single dose of dsRNA, wherein the second single dose is administered at least 5, more preferably 7, 10, 14, 21, 25, 30 or 40 days after the first single dose is administered, thereby inhibiting the expression of the target gene in a subject.

In one embodiment, doses of siRNA are administered not more than once every four weeks, not more than once every three weeks, not more than once every two weeks, or not more than once every week. In another embodiment, the administrations can be maintained for one, two, three, or six months, or one year or longer.

In another embodiment, administration can be provided when Hb levels reach or drop lower than a predetermined minimal level, such as less than 8 g/dL, 9 g/dL, or 10 g/dL. In some aspects, administration is continued until Hb levels are >11 g/dL, e.g, 12 g/dL.

In another embodiment, administration can be provided when a patient presents with various known symptoms of disorders such as anemia. These can include fatigue, shortness of breath, headache, dizziness, or pale skin.

In another embodiment, administration can be provided when a patient is diagnosed with anemia via CBC.

In general, the siRNA does not activate the immune system, e.g., it does not increase cytokine levels, such as TNF-alpha or IFN-alpha levels. For example, when measured by an assay, such as an in vitro PBMC assay, such as described herein, the increase in levels of TNF-alpha or IFN-alpha, is less than 30%, 20%, or 10% of control cells treated with a control dsRNA, such as a dsRNA that does not target HAMP, HFE2, HFE, TFR2, BMPR1a, SMAD4, IL6R, BMP6, and/or NEO1.

In an aspect, a subject can be administered a therapeutic amount of siRNA, such as 0.5 mg/kg, 1.0 mg/kg, 1.5 mg/kg, 2.0 mg/kg, or 2.5 mg/kg dsRNA. The siRNA can be administered by intravenous infusion over a period of time, such as over a 5 minute, 10 minute, 15 minute, 20 minute, or 25 minute period. The administration is repeated, for example, on a regular basis, such as biweekly (i.e., every two weeks) for one month, two months, three months, four months or longer. After an initial treatment regimen, the treatments can be administered on a less frequent basis. For example, after administration biweekly for three months, administration can be repeated once per month, for six months or a year or longer. Administration of the siRNA can reduce HAMP, HFE2, HFE, TFR2, BMPR1a, SMAD4, IL6R, BMP6, and/or NEO1 levels, e.g., in a cell, tissue, blood, urine or other compartment of the patient by at least 10%, at least 15%, at least 20%, at least 25%, at least 30%, at least 40%, at least 50%, at least 60%, at least 70%, at least 80% or at least 90% or more.

Before administration of a full dose of the siRNA, patients can be administered a smaller dose, such as a 5% infusion reaction, and monitored for adverse effects, such as an allergic reaction, or for elevated lipid levels or blood pressure. In another example, the patient can be monitored for unwanted immunostimulatory effects, such as increased cytokine (e.g., TNF-alpha or IFN-alpha) levels.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given siRNA drug or formulation of that drug can also be judged using an experimental animal model for the given disease as known in the art. When using an experimental animal model, efficacy of treatment is evidenced when a statistically significant reduction in a marker or symptom is observed.

Additional Agents and Co-Administration

In further embodiments, administration of a siRNA is administered in combination an additional therapeutic agent. The siRNA and an additional therapeutic agent can be administered in combination in the same composition, e.g., parenterally, or the additional therapeutic agent can be administered as part of a separate composition or by another method described herein.

In one embodiment, the siRNA is administered to the patient, and then the additional therapeutic agent is administered to the patient (or vice versa). In another embodiment, the siRNA and the additional therapeutic agent are administered at the same time.

In some aspects, the additional agent can include one or more Erythropoiesis-stimulating agents (ESAs). ESAs are generally known in the art. ESAs can include Erythropoietin (EPO), Epoetin alfa (Procrit/Epogen), Epoetin beta (NeoRecormon), Darbepoetin alfa (Aranesp), and Methoxy polyethylene glycol-epoetin beta (Micera). ESAs can be administered in various doses, e.g., 7,000 U/week to 30,000 U/week.

In some aspects, the additional agent can include intravenous iron. Iron can be administered in various doses known in the art.

In some aspects, two or more dsRNAs are co-administered to a subject. In one embodiment, a first dsRNA is administered to the patient, and then a second dsRNA is administered to the patient (or vice versa). In another embodiment, the first dsRNA and the second dsRNA are administered at the same time.

In some aspects, a HAMP dsRNA is co-administered with one or more dsRNAs selected from HFE2, HFE, TFR2, BMPR1a, SMAD4, IL6R, BMP6, and/or NEO1 dsRNAs.

In some aspects, a HFE2 dsRNA is co-administered with one or more dsRNAs selected from HAMP, HFE, TFR2, BMPR1a, SMAD4, IL6R, BMP6, and/or NEO1dsRNAs.

In some aspects, a HFE dsRNA is co-administered with one or more dsRNAs selected from HAMP, HFE2, TFR2, BMPR1a, SMAD4, IL6R, BMP6, and/or NEO1dsRNAs.

In some aspects, a TFR2 dsRNA is co-administered with one or more dsRNAs selected from HAMP, HFE2, HFE, BMPR1a, SMAD4, IL6R, BMP6, and/or NEO1dsRNAs.

In some aspects, a BMPR1a dsRNA is co-administered with one or more dsRNAs selected from HAMP, HFE2, HFE, TFR2, SMAD4, IL6R, BMP6, and/or NEO1 dsRNAs.

In some aspects, a SMAD4 dsRNA is co-administered with one or more dsRNAs selected from HAMP, HFE2, HFE, TFR2, BMPR1a, IL6R. BMP6, and/or NEO1 dsRNAs.

In some aspects, an IL6R dsRNA is co-administered with one or more dsRNAs selected from HAMP, HFE2, HFE, TFR2, BMPR1a, SMAD4, BMP6, and/or NEO1dsRNAs.

In some aspects, a BMP6 dsRNA is co-administered with one or more dsRNAs selected from HAMP, HFE2, HFE, TFR2, BMPR1a, SMAD4, IL6R, and/or NEO1dsRNAs.

In some aspects, a NEO dsRNA is co-administered with one or more dsRNAs selected from HAMP, HFE2, HFE, TFR2, BMPR1a, SMAD4, IL6R, and/or BMP6 dsRNAs.

In another aspect, the invention features, a method of instructing an end user, e.g., a caregiver or a subject, on how to administer a siRNA described herein. The method includes, optionally, providing the end user with one or more doses of the siRNA, and instructing the end user to administer the siRNA on a regimen described herein, thereby instructing the end user.

Identification of Subjects in need of dsRNA Administration

In one aspect, the invention provides a method of treating a patient by selecting a patient on the basis that the patient is in need of iron mobilization. The method includes administering to the patient a siRNA in an amount sufficient to increase the patient's iron mobilization.

In one aspect, the invention provides a method of treating a patient by selecting a patient on the basis that the patient is in need of increased Hb levels. Such a subject can have Hb levels of <9 g/dL. The method includes administering to the patient a siRNA in an amount sufficient to increase the patient's Hb levels. Typically target Hb levels are >11 g/dL, e.g., 11 g/dL or 12 g/dL.

In some aspects, a subject is identified as having anemia. In some aspects, a subject is identified as having a refractory form of anemia. In some aspects, a subject is identified as having ACD. Such subjects can be in need of administration of a dsRNA described herein. ACD can include a form of anemia wherein the subject is refractory to ESAs and/or i.v. iron administration. Typical clinical presentation of ACD includes fatigue, shortness of breadth, headache, dizziness, and/or pale skin. ACD can also be diagnosed via a CBC test, which is generally known in the art. ACD can also be diagnosed via serum iron levels, Tf saturation, and/or ferritin levels. ACD is typically diagnosed in certain settings such as subjects with CKD, cancer, chronic inflammatory diseases such as RA, or IRIDA. In some aspects, a subject with ACD has Hb levels of less than 9 g/dL. Such subjects typically become symptomatic for ACD.

CKD can result in reduced renal EPO synthesis, dietary hematinic deficiencies, blood loss, and/or elevated hepcidin levels. The elevation in hepcidin levels can be due to decreased renal excretion and/or low grade inflammation characterized by, e.g., interleukin (IL)-6.

In some aspects, a subject is identified as having iron-restricted erythropoiesis (IRE). Such subjects can be in need of administration of a dsRNA described herein. IRE can be assessed via reticulocyte Hb (CHr). Typically a result of <28 pg suggests IRE, where normal is in the range of 28-35 pg. IRE can also be assessed via percent (%) hypochromic RBCs. Typically a result of >10% suggests IRE, where 1-5% is generally considered normal.

A healthcare provider, such as a doctor, nurse, or family member, can take a family history before prescribing or administering a siRNA. In addition, a test may be performed to determine a genotype or phenotype. For example, a DNA test may be performed on a sample from the patient, e.g., a blood sample, to identify the relevant genotype and/or phenotype before a dsRNA is administered to the patient. In another embodiment, a test is performed to identify a related genotype and/or phenotype.

Unless otherwise defined, all technical and scientific terms used herein have the same meaning as commonly understood by one of ordinary skill in the art to which this invention belongs. Although methods and materials similar or equivalent to those described herein can be used in the practice or testing of the dsRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 dsRNA Synthesis

Source of Reagents

Where the source of a reagent is not specifically given herein, such reagent may be obtained from any supplier of reagents for molecular biology at a quality/purity standard for application in molecular biology.

siRNA Synthesis

Single-stranded RNAs were produced by solid phase synthesis on a scale of 1 µmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim, Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim. Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was stored at −20° C. until use.

Nucleic acid sequences are represented below using standard nomenclature, and specifically the abbreviations of Table 1.

TABLE 1

Abbreviations

| Abbreviation | Nucleotide(s) |
|---|---|
| A | adenosine-3'-phosphate |
| C | cytidine-3'-phosphate |
| G | guanosine-3'-phosphate |
| U | uridine-3'-phosphate |
| N | any nucleotide (G, A, C, or T) |
| a | 2'-O-methyladenosine-3'-phosphate |
| c | 2'-O-methylcytidine-3'-phosphate |
| g | 2'-O-methylguanosine-3'-phosphate |
| u | 2'-O-methyluridine-3'-phosphate |
| T, dT | 2'-deoxythymidine-3'-phosphate |
| sT; sdT | 2'-deoxy-thymidine-5'phosphate-phosphorothioate |
| Af | 2'-fluoroadenosine-3'-phosphate |
| Cf | 2'-fluorocytidine-3'-phosphate |
| Gf | 2'-fluoroguanosine-3'-phosphate |
| Uf | 2'-fluorouridine-3'-phosphate |

Example 2

HAMP siRNA Design

Transcripts siRNA design was carried out to identify siRNAs targeting human, cynomolgus monkey (*Macaca fascicularis*; herein "cyno"), mouse, and rat HAMP transcripts annotated in the NCBI Gene database ncbi.nlm.nih.gov/gene website. In mouse, the HAMP gene is duplicated, yielding distinct HAMP1 and HAMP2 loci; duplex designs targeted only HAMP1. Design used the following transcripts from the NCBI RefSeq and GenBank collections: Human—NM_021175.2 (SEQ ID NO:1); Cyno—EU076443.1; Mouse—NM_032541.1; Rat—NM_053469.1. Due to the short length of the HAMP transcripts and the high degree of primate/rodent HAMP sequence divergence, siRNA duplexes were designed in multiple separate batches. The separate batches are listed below and matched the various species as follows:

human and cyno HAMP, exactly;
only human HAMP, exactly;
human and cyno HAMP, with mismatches to HAMP in both species allowed at sense-strand position 19 when a G or C HAMP targeting-nucleotide was replaced with a U or A, i.e. "UA-swap";
human and cyno HAMP, with exact match to human HAMP and mismatches to cyno HAMP allowed at sense-strand positions 1, 2, and 19, i.e. "mismatch-to-cyno";
mouse HAMP1, exactly;
only rat HAMP, exactly.

All siRNA duplexes were designed that shared 100% identity with all listed human, cyno, mouse, or rat transcripts with the exception(s) of designated mismatched-to-target bases. Unless otherwise noted, duplexes themselves were 100% complementary and double-stranded.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand.

Table 2 provides the sequences of the sense and antisense strands of 42 duplexes targeting the 3'UTR of the human HAMP gene.

Table 3 provides the sequences of the sense and antisense strands of 47 duplexes targeting the CDS of the human HAMP gene.

Table 4 provides the sequences of the sense and antisense strands of the modified duplexes targeting the HAMP gene.

Table 5 provides the sequences of the sense and antisense strands of the unmodified version of the duplexes shown in Table 4.

The antisense-derived human/cyno, mouse, rat, UA-swap, and mismatch-to-cyno oligonucleotides shown in Tables 3-4 were synthesized and formed into duplexes.

In some instances the duplexes contained no chemical modifications (unmodified).

In some instances the duplexes contained modifications (modified). For example, some duplexes were made with "Light Fluoro" chemical modifications as follows: all pyrimidines (cytosine and uridine) in the sense strand were replaced with corresponding 2'-Fluoro bases (2' Fluoro C and 2'-Fluoro U). In the antisense strand, pyrimidines adjacent to (towards 5' position) ribo A nucleoside was replaced with their corresponding 2-Fluoro nucleosides.

Example 3

HAMP siRNA Screening

Cell Culture and Transfections:
Dual Luciferase System:

COS 7 cells (ATCC, Manassas, Va.) were grown to near confluence at 37° C. in an atmosphere of 5% $CO_2$ in DMEM (Gibco) supplemented with 10% FBS before being released from the plate by trypsinization. Cells were transfected with a psiCHECK2 vector (Promega) containing the human HAMP open reading frame (ORF). The ORF was introduced following the stop codon in the *renilla* luciferase sequence. Plasmid transfection was carried out by adding 19.8 µl of Opti-MEM plus 0.2 µl of Lipofectamine RNAiMax per well (Invitrogen, Carlsbad Calif. cat #13778-150) and 2.5 ng plasmid into a 96-well plate and incubated at room temperature for 15 minutes. 80 µl of complete growth media containing ~2×10⁴ COS7 cells were then added. Cells were incubated for three hours, after which the media was removed from the wells and replaced with 80 µl of complete growth media. Transfection of siRNA was accomplished out by preparing adding 14.8 µl of Opti-MEM plus 0.2 µl of Lipofectamine RNAiMax per well (Invitrogen, Carlsbad Calif. cat #13778-150) to 5 µl of siRNA duplexes per well into a new 96-well plate and incubated at room temperature for 15 minutes. The 20 µl volumes containing the lipoplexes were then added over the culture plates and incubated for 48 hours. Single dose experiments were performed at final concentrations of 10 nM and 0.1 nM. An additional concentration of 0.01 nM was performed for selected duplexes. Final duplex concentrations for dose response experiments were 10, 1.67, 0.278, 0.046, 0.0077, 0.0012, 0.0002, and 0.000035 nM.

Endogenous System (Human):

For HAMP, HepG2 cells were used. HepG2 cells (ATCC, Manassas, Va.) were grown to near confluence at 37° C. in an atmosphere of 5% $CO_2$ in MEM (Gibco) supplemented with 10% FBS before being released from the plate by trypsinization. Transfection was carried out by adding 14.8 µl of Opti-MEM plus 0.2 µl of Lipofectamine RNAiMax per well (Invitrogen, Carlsbad Calif. cat #13778-150) to 5 µl of siRNA duplexes per well into a 96-well plate and incubated at room temperature for 15 minutes. 80 µl of complete growth media without antibiotic containing ~2×10⁴ HepG2 cells were then added to the siRNA mixture. Cells were incubated for 24 hours prior to RNA purification. Single dose experiments were performed at final concentrations of 10 nM and 0.1 nM. An additional concentration of 0.0 nM was performed for selected duplexes. Final duplex concentrations for dose response experiments were 10, 1.67, 0.278, 0.046, 0.0077, 0.0012, 0.0002, and 0.000035 nM.

Endogenous System (Cynomolgus):

Transfection was carried out by adding 14.8 µl of Opti-MEM plus 0.2 µl of Lipofectamine RNAiMax per well (Invitrogen, Carlsbad Calif. cat #13778-150) to 5 µl of siRNA duplexes per well into a 96-well plate and incubated at room temperature for 15 minutes. Primary cynomolgus hepatocytes (M003055-P, Celsis) were thawed and prepared in InVitroGRO CP plating medium (Z99029, Celsis). 80 µl of complete growth media without antibiotic containing ~2×10⁴ cynomolgus hepatocytes were then added to the siRNA mixture. Cells were incubated for 24 hours prior to RNA purification. Single dose experiments were performed at final concentrations of 10 nM and 0.1 nM. Final duplex concentrations for dose response experiments were 10, 1.67, 0.278, 0.046, 0.0077, 0.0012, 0.0002, and 0.000035 nM.

Dual Luciferase Assay (Promega Part E2980):

For cells transfected with the psiCHECK2 vector containing the human HAMP ORF, the Dual Luciferase assay was performed to measure reduction in HAMP levels. Forty-eight hours after transfection, the media was removed over the cells, and cells received 150 uL of a 1:1 mixture of complete growth medium and Dual-Glo Luciferase Reagent. As a control, these reagents were also added to empty wells; data derived from these samples were thus used as a blank measurement. Cells were then incubated for 30 minutes at room temperature on a shaker, protected from light. At this time, luminescence was determined using a SpectraMax M5 (Molecular Devices) with an integration time of 500 ms, and resulting data defined as the firefly luciferase signal. Following measurement, 75 µL of Dual-Glo Stop & Glo Reagent was added and the plates incubated in the dark at room temperature, without shaking. After an additional 10 minutes luminescence was again measured as above, and resulting data defined as the *renilla* luciferase signal. Data were background-subtracted, and the *renilla* values normalized to the firefly Luciferase values. Data were then expressed as percent mock-transfected or percent AD-1955.

Total RNA Isolation Using DYNABEADS mRNA Isolation Kit (Invitrogen, Part #: 610-12):

Cells were harvested and lysed in 150 µl of Lysis/Binding Buffer then mixed for 5 minute at 850 rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 µl Wash Buffer A and mixed for 1 minute. Beads were capture again and supernatant removed. Beads were then washed with 150 µl Wash Buffer B, captured and supernatant was removed. Beads were next washed with 150 µl Elution Buffer, captured and supernatant removed. Beads were allowed to dry for 2 minutes. After drying, 50 µl of Elution Buffer was added and mixed for 5 minutes at 70° C. Beads were captured on magnet for 5 minutes. 40 µl of supernatant was removed and added to another 96 well plate.

cDNA Synthesis Using ABI High Capacity cDNA Reverse Transcription Kit (Applied Biosystems, Foster City, Calif., Cat #4368813):

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction were added into 10 µl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

For human HAMP, 2 µl of cDNA were added to a master mix containing 0.5 µl GAPDH TaqMan Probe (Applied Biosystems Cat #4326317E), 0.5 µl HAMP TaqMan probe (Applied Biosystems cat #Hs00221783_m1 https://products.appliedbiosystems.com/ab/en/US/adirect/ab?cmd=ABAssayDe tailDisplay&assayed=Hs01127366 m1) and 5 µl Lightcycler 480 probe master mix (Roche Cat #04887301001) per well in a 384 well 50 plates (Roche cat #04887301001). For cynomolgus HAMP, 2 µl of cDNA were added to a master mix containing 0.5 µl 18s TaqMan Probe (Applied Biosystems Cat #4319413 E), 0.1 µl 10× custom cynomolgus HAMP probe (Forward primer: CTC-CGTTTTCCCACAACA (SEQ ID NO: 39); Reverse primer: CAGCACATCCCACACTTT (SEQ ID NO: 40); Probe: ACCCACTTCCCCATCTGCATT (SEQ ID NO: 41)), and 5 µl Lightcycler 480 probe master mix (Roche Cat #04887301001) per well in a 384 well 50 plates (Roche cat #04887301001). Real time PCR was done in an ABI 7900HT Real Time PCR system (Applied Biosystems) using the ΔΔCt (RQ) assay. Each duplex was tested in two independent transfections and each transfection was assayed in duplicate, unless otherwise noted in the summary tables.

To calculate relative fold change, real time data were analyzed using the ΔΔCt method and normalized to assays performed with cells transfected with 100 nM AD-1955, or mock transfected cells. IC50s were calculated using a 4 parameter fit model using XLFit and normalized to cells transfected with 10 nM AD-1955, mock transfected, or to the average lowest dose.

Table 6 shows the HAMP single dose screening data of the modified duplexes using the dual luciferase assay. Data are expressed as a percent of mock or AD-1955.

Table 7 shows the HAMP single dose screening data of the unmodified duplexes using the human endogenous assay. Data are expressed as a percent of mock.

Table 8 shows the HAMP single dose screening data of the modified duplexes using the human endogenous assay. Data are expressed as a percent of mock.

Table 9 shows the HAMP dose response data of modified and unmodified duplexes using the dual luciferase assay. Cells used included HepG2 and Cyno primary hepatocytes.

Example 4

HFE2 siRNA Design siRNA design was carried out to identify siRNAs targeting human, rhesus (*Macaca mulatta*), mouse, and rat HFE2 transcripts annotated in the NCBI Gene database website noted above. There are at least 4 annotated human HFE2 transcripts and at least 3 annotated rhesus transcripts. Accordingly, we focused on the shortest annotated transcript for human, and the rhesus transcript which shared the greatest number of orthologous human exons, and designed on sequences held in common by the alternate transcripts. Design used the following transcripts from the NCBI RefSeq collection: Human—NM_213652.3; Rhesus—XM_001092987.1; Mouse—NM_027126.4; Rat—NM_001012080.1. Due to high primate/rodent sequence divergenge, siRNA duplexes were designed in two separate batches. The first batch matched human and rhesus; the second matched mouse and rat. All siRNA duplexes were designed that shared 100% identity with all listed human/rhesus or mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 4 or more Us or As in the seed region.

siRNA Sequence Selection

A total of 47 sense and 47 antisense derived human/rhesus, and 40 sense and 40 antisense derived mouse/rat siRNA oligos were synthesized and formed into duplexes.

Table 10A provides the sequences of the sense and antisense strands of the duplexes targeting the HFE2 gene.

Example 5

TFR2 siRNA Design

Transcripts siRNA design was carried out to identify siRNAs targeting human, rhesus (*Macaca mulatta*), mouse, and rat TFR2 transcripts annotated in the NCBI Gene database website noted above. Design used the following transcripts from the NCBI RefSeq collection: Human—NM_003227.3, NM_001206855.1; Rhesus—XM_001113151.2; Mouse—NM_015799.3; Rat—NM_001105916.1. Due to high primate/rodent sequence divergenge, siRNA duplexes were designed in three separate batches. The first batch matched human and rhesus; the second matched human, rhesus, and mouse; the last batch matched mouse and rat. All siRNA duplexes were designed that shared 100% identity with all listed human/rhesus, human/rhesus/mouse, or mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 3 or more Us or As in the seed region.

siRNA Sequence Selection

A total of 40 sense and 40 antisense derived human/rhesus, 5 sense and 5 antisense derived human/rhesus/mouse, and 45 sense and 45 antisense derived mouse/rat siRNA oligos were synthesized and formed into duplexes.

Table 10B provides the sequences of the sense and antisense strands of the duplexes targeting the TFR2 gene.

Example 6

HFE2 and TFR2 siRNA Screening

Cell Culture and Transfections:

Endogenous system (Human): For TFR2, HepG2 cells were used; Hep3b cells were used for HFE2. HepG2 and Hep3b cells (ATCC, Manassas, Va.) were grown to near confluence at 37° C. in an atmosphere of 5% $CO_2$ in MEM (Gibco) supplemented with 10% FBS before being released from the plate by trypsinization. Transfection was carried out by adding 14.8 μl of Opti-MEM plus 0.2 μl of Lipofectamine RNAiMax per well (Invitrogen, Carlsbad Calif. cat #13778-150) to 5 μl of siRNA duplexes per well into a 96-well plate and incubated at room temperature for 15 minutes. 80 μl of complete growth media without antibiotic containing ~2 ×$10^4$ HepG2 cells were then added to the siRNA mixture. Cells were incubated for 24 hours prior to RNA purification. Single dose experiments were performed at final concentrations of 10 nM and 0.1 nM. An additional concentration of 0.01 nM was performed for selected duplexes. Final duplex concentrations for dose response experiments were 10, 1.67, 0.278, 0.046, 0.0077, 0.0012, 0.0002, and 0.000035 nM.

Total RNA Isolation Using DYNABEADS mRNA Isolation Kit (Invitrogen, Part #: 610-12):

Cells were harvested and lysed in 150 μl of Lysis/Binding Buffer then mixed for 5 minute at 850 rpm using an Eppendorf Thermomixer (the mixing speed was the same throughout the process). Ten microliters of magnetic beads and 80 μl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 μl Wash Buffer A and mixed for 1 minute. Beads were capture again and supernatant removed. Beads were then washed with 150 μl Wash Buffer B, captured and supernatant was removed. Beads were next washed with 150 μl Elution Buffer, captured and supernatant removed. Beads were allowed to dry for 2 minutes. After drying, 50 μl of Elution Buffer was added and mixed for 5 minutes at 70° C. Beads were captured on magnet for 5 minutes. 40 μl of supernatant was removed and added to another 96 well plate.

cDNA Synthesis Using ABI High Capacity cDNA Reverse Transcription Kit (Applied Biosystems, Foster City, Calif. Cat #4368813):

A master mix of 2 μl 10× Buffer, 0.8 μl 25×dNTPs, 2 μl Random primers, 1 μl Reverse Transcriptase, 1 μl RNase inhibitor and 3.2 μl of H2O per reaction were added into 10 μl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 μl of cDNA were added to a master mix containing 0.5 μl GAPDH TaqMan Probe (Applied Biosystems Cat #4326317E), 0.5 μl HFE2 or TFR2 probes, and 5 μl Lightcycler 480 probe master mix (Roche Cat #04887301001) per well in a 384 well 50 plates (Roche cat #04887301001). HFE2 and TFR2 probes were Applied Biosystems cat #Hs02378779_s1 and Hs00162690_m1, respectively. Real time PCR was done in an ABI 7900HT Real Time PCR system (Applied Biosystems) using the ΔΔCt(RQ) assay. Each duplex was tested in two independent transfections and each transfection was assayed in duplicate, unless otherwise noted in the summary tables.

To calculate relative fold change, real time data were analyzed using the ΔΔCt method and normalized to assays performed with cells transfected with 10 nM AD-1955, or mock transfected cells. IC50s were calculated using a 4 parameter fit model using XLFit and normalized to cells transfected with 10 nM AD-1955, mock transfected, or to the average lowest dose.

Table 11 shows the HFE2 and TFR2 single dose screening data of the duplexes using the human endogenous assay.

Table 12 shows the HFE2 and TFR2 dose response data of the duplexes.

Example 7

HFE siRNA Design

Transcripts siRNA design was carried out to identify siRNAs targeting human, rhesus (*Macaca mulatta*), mouse, and rat HFE transcripts annotated in the NCBI Gene database website noted above. There are at least 9 annotated human HFE transcripts, at least 5 annotated rhesus transcripts, and at least 4 annotated rat transcripts. Accordingly, we focused on the shortest annotated transcripts for human, rhesus, and rat HFE, and designed on sequences held in common by the alternate transcripts. Design used the following transcripts from the NCBI RefSeq collection: Human—NM_139006.2; Rhesus—XM_001085598.2; Mouse—NM_010424.4; Rat—NM_001173435.1. Due to high primate/rodent sequence divergenge, siRNA duplexes were designed in two separate batches. The first batch matched human and rhesus; the second matched mouse and rat. All siRNA duplexes were designed that shared 100% identity with all listed human/rhesus or mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 3 or more Us or As in the seed region.

siRNA Sequence Selection

A total of 46 sense and 46 antisense derived human/rhesus, and 24 sense and 24 antisense derived mouse/rat siRNA oligos are synthesized and formed into duplexes. The duplexes are screened using the methods described above. One or more duplexes are selected for further testing.

Example 8

BMPR1a siRNA Design

Transcripts siRNA design was carried out to identify siRNAs targeting mouse and rat BMPR1A transcripts annotated in the NCBI Gene database website noted above. Design used the following transcripts from the NCBI RefSeq collection: Mouse—NM_009758.4; Rat—NM_030849.1. All siRNA duplexes were designed that shared 100% identity with all listed mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 4 or more Us or As in the seed region.

siRNA Sequence Selection

A total of 46 sense and 46 antisense derived mouse/rat siRNA oligos are synthesized and formed into duplexes. The duplexes are screened using the methods described above. One or more duplexes are selected for further testing.

Example 9

SMAD4 siRNA Design

Transcripts siRNA design was carried out to identify siRNAs targeting human and mouse SMAD4 transcripts annotated in the NCBI Gene database website noted above. Design used the following transcripts from the NCBI RefSeq collection: Human—NM_005359.5; Mouse—NM_008540.2. All siRNA duplexes were designed that shared 100% identity with all listed human/mouse transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 4 or more Us or As in the seed region.

siRNA Sequence Selection

Tables 15-16 provide the sequences of the sense and antisense strands of the duplexes targeting SMAD4 mRNA at the indicated locations. Some duplexes were modified as indicated. These siRNA oligos were synthesized and formed into duplexes for further testing as described below.

Example 10

IL6R siRNA Design

Transcripts siRNA design was carried out to identify siRNAs targeting mouse and rat IL6R transcripts annotated in the NCBI Gene database website noted above. Design used the following transcripts from the NCBI RefSeq collection: Mouse—NM_010559.2; Rat—NM_017020.3. All siRNA duplexes were designed that shared 100% identity with all listed mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position and had 2 or more Us or As in the seed region.

siRNA Sequence Selection

A total of 44 sense and 44 antisense derived mouse/rat siRNA oligos are synthesized and formed into duplexes. The duplexes are screened using the methods described above. One or more duplexes are selected for further testing.

Example 11

BMP6 siRNA Design

Transcripts siRNA design was carried out to identify siRNAs targeting human, rhesus (*Macaca mulatta*), mouse, and rat BMP6 transcripts annotated in the NCBI Gene database website noted above. Design used the following transcripts from the NCBI RefSeq collection: Human—NM_001718.4; Rhesus—XM_001085364.2; Mouse—NM_007556.2; Rat—NM_013107.1. Due to high primate/rodent sequence divergenge, siRNA duplexes were designed in three separate batches. The first batch matched human and rhesus; the second matched human, rhesus, and mouse: the last batch matched mouse and rat. All siRNA duplexes were designed that shared 100% identity with all listed human/rhesus, human/rhesus/mouse, or mouse/rat transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 3 or more Us or As in the seed region.

siRNA Sequence Selection

Table 21 provides the sequences of the sense and antisense strands of the duplexes targeting BMP6 mRNA. Some duplexes were modified as indicated. These siRNA oligos were synthesized and formed into duplexes for further testing using the methods described herein.

Example 12

Neo1 siRNA Design

Transcripts siRNA design was carried out to identify siRNAs targeting human and mouse NEO1 transcripts annotated in the NCBI Gene database website noted above. There are 2 annotated mouse NEO1 transcripts. Accordingly, we focused on the shortest annotated transcripts for mouse NEO1, and designed on sequences held in common by the alternate transcripts. Design used the following transcripts from the NCBI RefSeq collection: Human—NM_002499.2; Mouse—NM_001042752.1. All siRNA duplexes were designed that shared 100% identity with all listed human/mouse transcripts.

siRNA Design, Specificity, and Efficacy Prediction

The predicted specificity of all possible 19mers was predicted from each sequence. Candidate 19mers were selected that lacked repeats longer than 7 nucleotides. These siRNAs were used in comprehensive searches against the appropriate transcriptomes.

siRNAs strands were assigned to a category of specificity according to the calculated scores: a score above 3 qualifies as highly specific, equal to 3 as specific and between 2.2 and 2.8 as moderately specific. We sorted by the specificity of the antisense strand. We then selected duplexes whose antisense oligos lacked GC at the first position, lacked G at both positions 13 and 14, and had 3 or more Us or As in the seed region.

siRNA Sequence Selection

Tables 17-18 provide the sequences of the sense and antisense strands of the duplexes targeting NEO1 mRNA at the indicated locations. Some duplexes were modified as indicated. These siRNA oligos were synthesized and formed into duplexes for further testing as described below.

Example 13

Activity of Murine siRNA in Vivo

The efficacy of one or more siRNAs described above is determined in mice, e.g., normal 10 week old 129s6/svEvTac mice using AD-1955 targeting luciferase as a control. The siRNAs are formulated as described herein and administered, e.g., through i.v. bolus at a dose of e.g., 10 mg/kg. Forty eight hours after injection, the liver and serum samples are harvested. The liver mRNA levels of the target mRNA are determined by qRT-PCR using gene specific primers and serum iron levels are determined using Feroxcine (Randox Life Sciences) and Hitachi 717 instrument.

siRNA that result in lowering of mRNA are selected for further evaluation.

Examples 14

Activity of Murine Hepcidin siRNA in Vivo

The efficacy of an HAMP siRNA AD-10812 was determined in mice using AF-011 formulated control siRNA and PBS as controls. Each siRNA was formulated with AF-011. AF-011 is also known as LNP11 (See Table A above; MC-3/DSPC/Cholesterol/PEG-DMG (50/10/38.5/1.5); Lipid: siRNA 10.1)).

| position in mouse access. # NM_03254 1.1 | sense strand sequence (5'-3') | SEQ ID NO | antisense strand sequence (5'-3') | SEQ ID NO | duplex name |
|---|---|---|---|---|---|
| 245-263 | uGcuGuAAcAAuucccAGuTsT | 42 | ACUGGGAAUUGUuAcAGcATsT | 43 | AD-10812 |

PBS and the siRNAs were administered at various dosages to the mice as shown in FIG. 1: 1 mg/kg, 0.3 mg/kg, 0.1 mg/kg, 0.03 mg/kg, 0.01 mg/kg, and 0.003 mg/kg. A single siRNA dose was administered to each mouse. After injection, liver and serum samples were harvested from the mice. the liver Hamp1 mRNA levels were determined by qRT-PCR using Hamp1 specific primers and serum iron levels were determined. FIG. 1 shows the HAMP1 mRNA levels in mouse liver following various dosages of siRNa and the serum iron concentration (μg/dL) following various dosages of siRNA.

Administration of AD-10812 HAMP siRNA to mice resulted in lowering of HAMP mRNA by >80% following a single dose. Adminidtration of AD-10812 HAMP siRNA to mice resulted in an approximatrely 2-fold increase in serum iron following a single dose.

Example 15

Activity of Hepcidin siRna in Nonhuman Primated (NHPs) in Vivo

The efficacy of an HAMP siRNA AD-11459 was determined in male cynomolgus monkeys using AF-011 siRNA as a control.

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-11459 | 382 | A-18280.2 | GAAcAuAGGucuuGGAAuAdTsdT | 30 | A-18304.1 | uAuUCcAAGACCuAuGuUCdTsdT | 44 |

Figure 2:
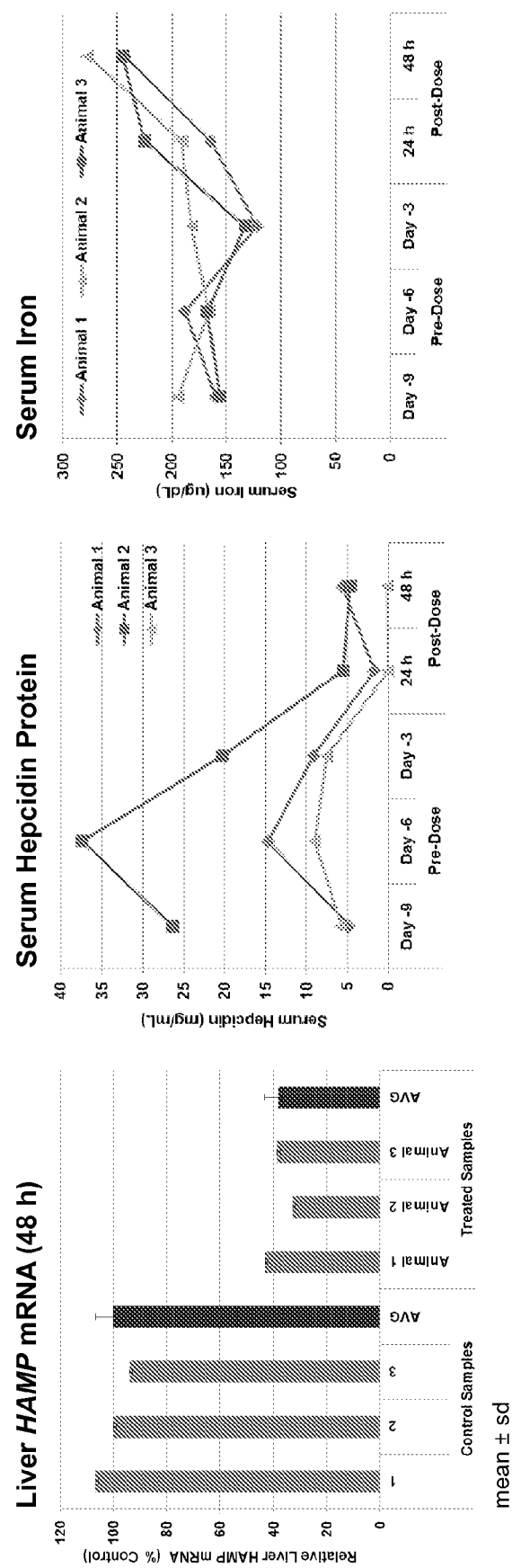
FIG. 2 shows the HAMP mRNA levels in liver following siRNA administration as well as the serum iron concentration (μg/dL) and the HAMP serum protein concentration (mg/mL) following siRNA administration to non-human primates.

Each siRNA was formulated with AF-011. The siRNA were administered intravenously at a dose of 1 mg/kg via a 15 minute infusion. A single siRNA dose was administered to each monkey. After injection, liver and serum samples were harvested. Liver samples were taken at 48 hours (h) post-injection. Serum samples were taken at Day-9, Day-6, Day-3, 24h post-injection, and 48h post-injection. The liver Hamp mRNA levels were determined by qRT-PCR using Hamp specific primers and serum iron levels were determined. Serum HAMP protein levels were also determined. FIG. 2 shows the HAMP mRNA levels in liver following siRNA administration as well as the serum iron concentration (μg/dL) and the HAMP serum protein concentration (mg/mL) following siRNA administration.

Single administration of LNP-siRNA AD-11459 resulted in rapid refuction of hepcidin mRNA and protein levels and elevation of serum iron levels in NHPs.

Examples 16

Silencing of Murine TFR2 Via siRNA in Vivo

Figure 3:
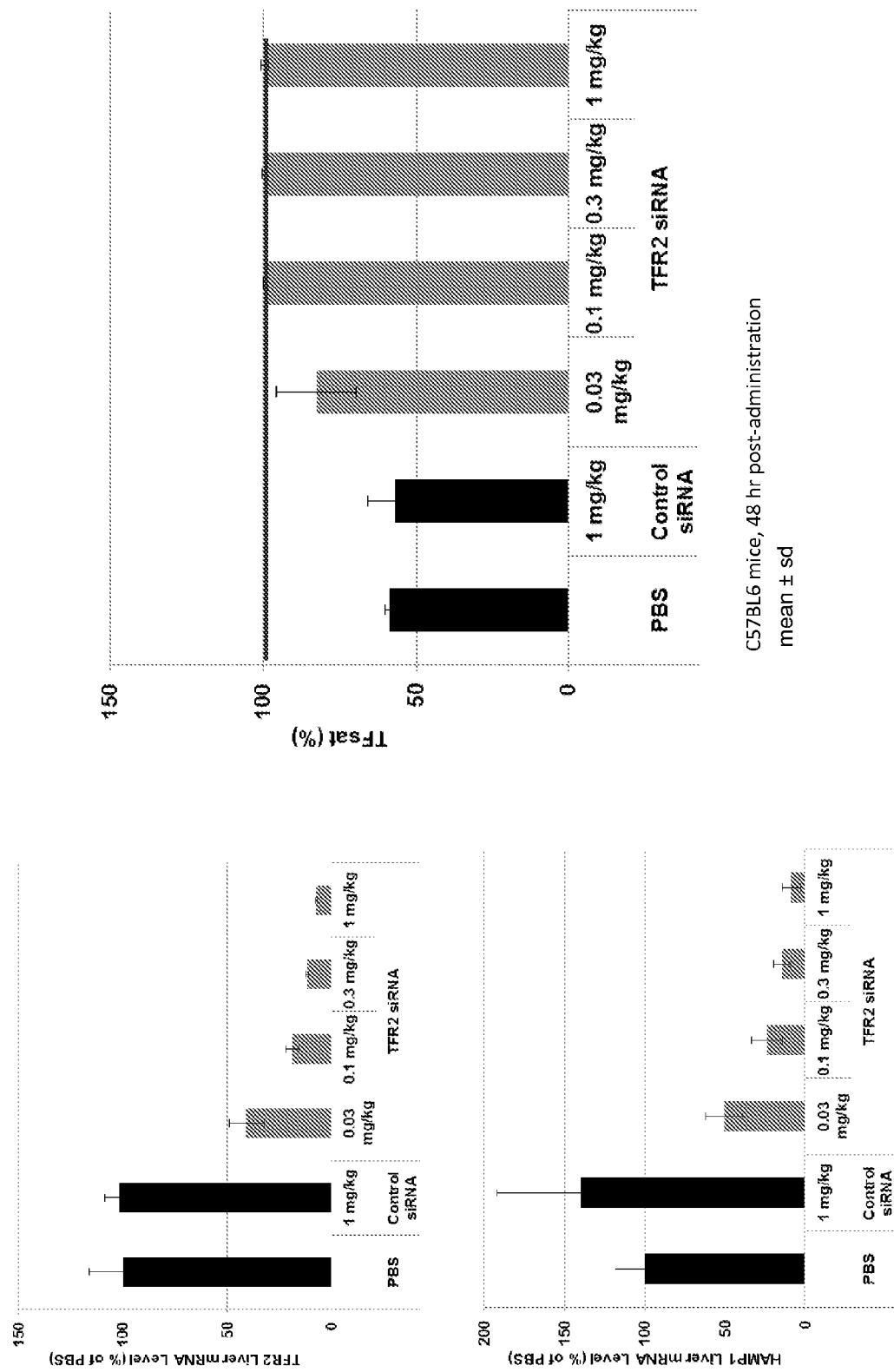
FIG. 3 shows the HAMP1 and TFR2 mRNA levels in mouse liver following various dosages of siRNA and the percent (%) transferrin saturation following various dosages of siRNA.

The efficacy of TFR2 siRNA AD-47882 (see table below for sequences) was determined in C57BL6 mice using AF-011 siRNA and PBS as controls. Each siRNA was formulated with AF-011. PBS and the siRNAs were administered at various dosages to the mice as shown in FIG. 3: 1 mg/kg, 0.3 mg/kg, 0.1 mg/kg, and 0.03 mg/kg. After injection, liver and serum samples were harvested from the mice. The liver Hamp1 and TFR2 mRNA levels were determined by qRT-PCR using gene specific primers and transferrin saturation were determine at 48 hours post-injection. FIG. 3 shows the HAMP1 and TFR2 mRNA levels in mouse liver following various dosages of siRNA and the percent (%) transferrin saturation following various dosages of siRNA.

| Target | Duplex ID | Sense Sequence | SEQ ID NO | Antisense Sequence | SEQ ID NO |
|---|---|---|---|---|---|
| TFR2 | AD-47882 | ccAcGuGAuucuccu uucudTsdT | 45 | AGAAAGGAGAAUcACG UGGdTsdT | 46 |

Administration of AD-47882 siRNA to mice resulted in lowering of HAMP and TFR2 mRNA levels. Administration of AD-47882 siRNA to mice resulted in an increase in trasferrin saturation.

Example 17

Silencing of Murine TFR2 Via siRNA in Vivo

Figure 4:
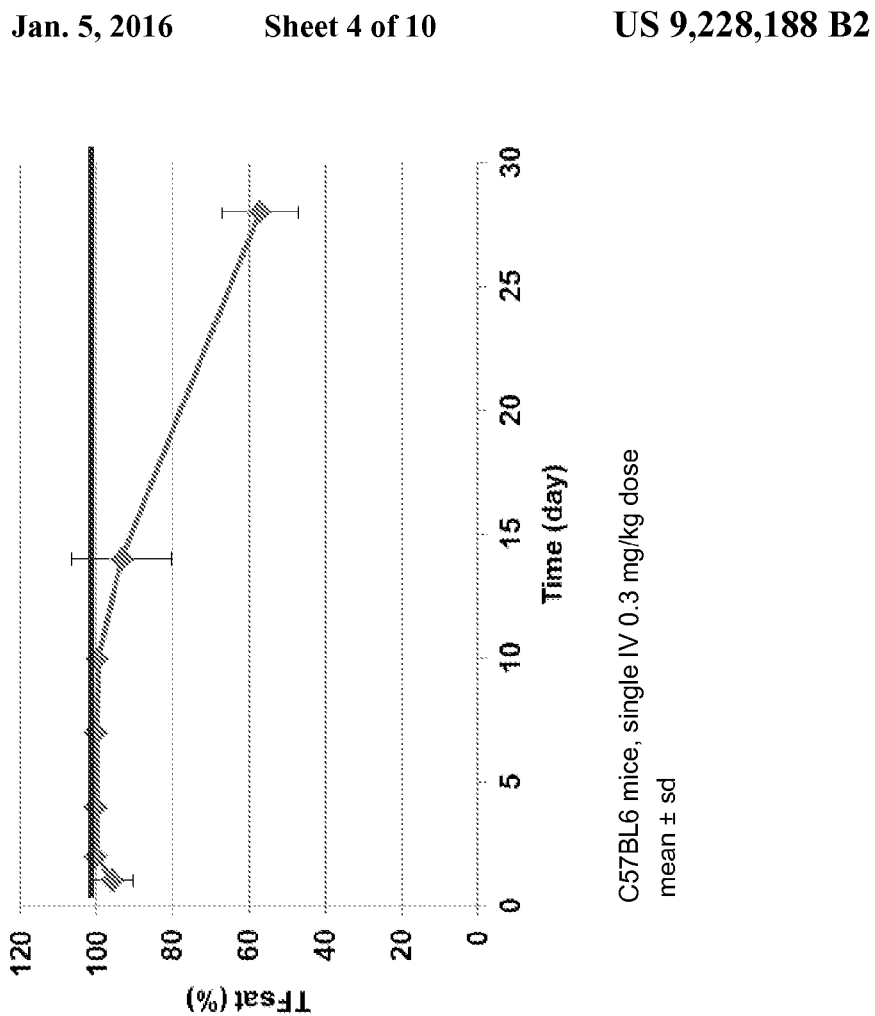
FIG. 4 shows the HAMP1 and TFR2 mRNA levels in mouse liver following administration of siRNA and the percent (%) transferrin saturation over a 30 day time course.
Figure 4:
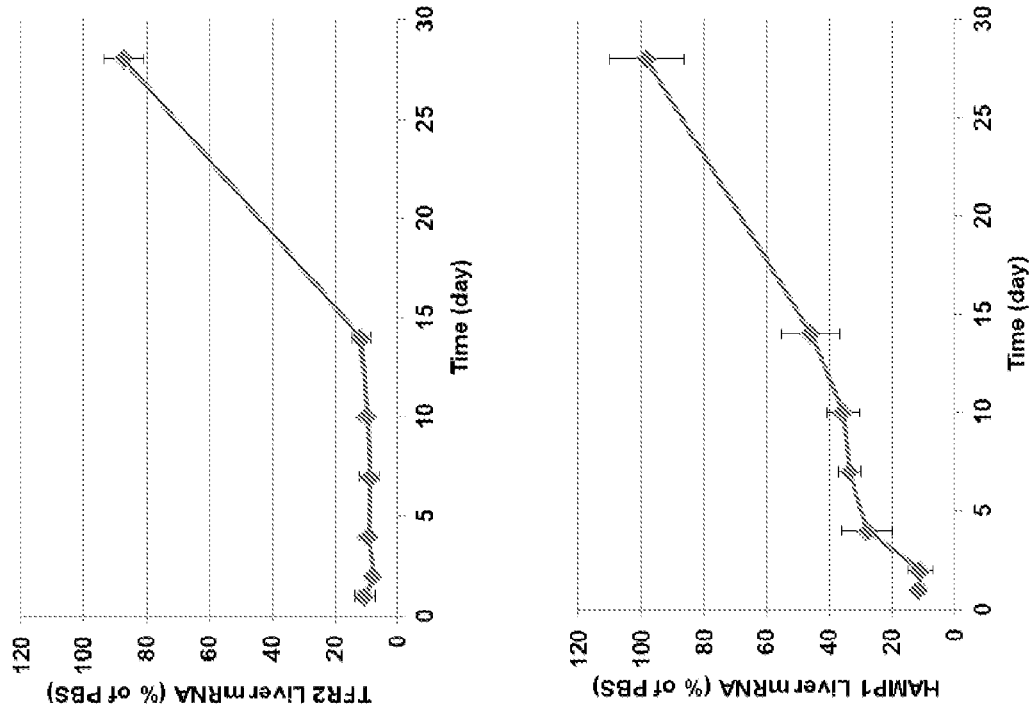

The duration of TFR2 siRNA AD-47882 was determined in C57BL6 mice. The siRNA were administered at in a single 0.3 mg/kg dose intravenously. Each siRNA was formulated with AF-011. After injection, liver and serum samples were harvested from the mice at various time points shown in FIG. 4. The liver Hamp1 and TFR2 Mrna levels were determined by qRT-PCR using gene specific primers and transferrin saturation were determined. FIG. 4 shows the HAMP1 and TFR2 mRNA levels in mouse liver following administration of siRNA and the percent (%) transferrin saturation over a 30 day time course.

Administration of AD-47882 siRNA to mice resulted in lowering of HAMP and TFR2 mRNA levels. Administration of AD-47882 siRNA to mice resulted in an increase in transferrin saturation.

Example 18

Silencing of Rat TFR2 Via siRNA In Vivo

Figure 5:
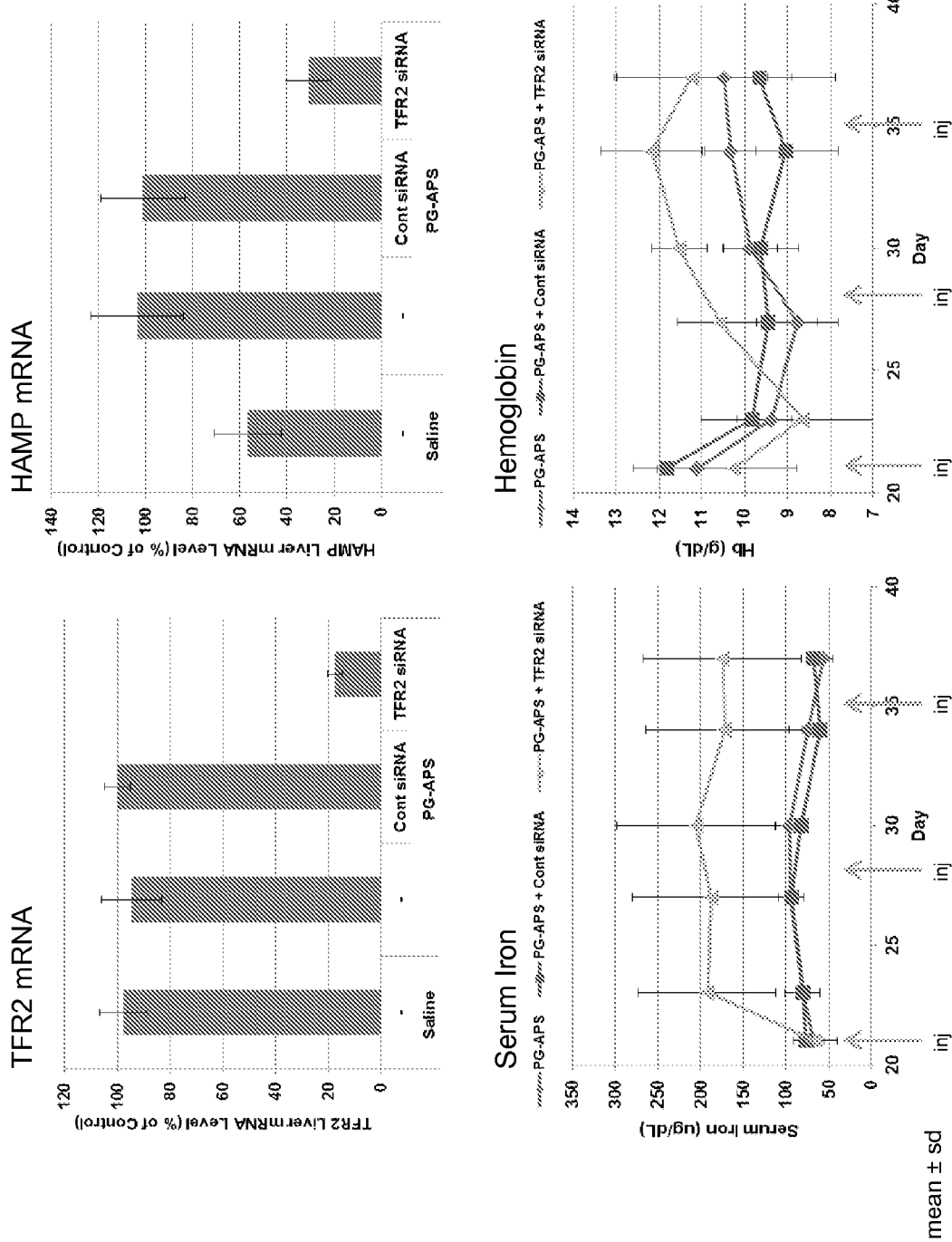
FIG. 5 shows the HAMP1 and TFR2 mRNA levels in rat liver following administration of siRNA.

The duration and efficacy of TFR2 siRNA AD-47882 was determined in male Lewis rats using the anemia of chronic disease (ACD) model described in Coccia et al., Exp. Hematology, 2001. Briefly, anemia was initiated in the rats with a single intraperaoneal (i.p.) injection of PG-APS (polymers from Group A Streptococci). The rats were then treated 3× per week with AD-47882 siRNA, AF-011 control siRNA, or saline control starting at day 21 post PG-APS. Each siRNA was formulated with AF-011. Serum and hematology parameters were measured biweekly and at 48 hours post final treatment. Serum samples were harvested from the rats at various time points as shown in FIG. 5. Liver mRNA measurement was taken at 48 hours post final treatment. FIG. 5 shows the HAMP1 and TFR2 mRNA levels in rat liver following administration of siRNA. FIG. 5 also shows the serum iron and Hb concentrations at various time points.

Administration of AD-47882 siRNA resulted in lowering of HAMP and TFR2 mRNA levels. Administration of AD-47882 siRNA resulted in an approximate 2× increase in serum iron upon treatment. Administration of AD-47882 siRNA resulted in an increase in Hb levels to 11-12 g/dL with treatment.

Example 19

TFR2 siRNA Selection and Screening siRNA Sequence Selection

Table 13 provides the sequences of the sense and antisense strands of the duplexes targeting the TFR2 gene at the indicated locations (64 or 239). These siRNA oligos were synthesized and formed into duplexes.

Cell Culture and Transfections:

Endogenous system (Human): For TFR2, HepG2 cells were used. HepG2 cells (ATCC, Manassas, Va.) were grown to near confluence at 37° C. in an atmosphere of 5% $CO_2$ in MEM (Gibco) supplemented with 10% FBS before being released from the plate by trypsinization. Transfection was carried out by adding 14.8 μl of Opti-MEM plus 0.2 μl of Lipofectamine RNAiMax per well (Invitrogen, Carlsbad Calif. cat #13778-150) to 5 μl of siRNA duplexes per well into a 96-well plate and incubated at room temperature for 15 minutes. 80 μl of complete growth media without antibiotic containing ~2×10$^4$ HepG2 cells were then added to the siRNA mixture. Cells were incubated for 24 hours prior to RNA purification. Single dose experiments were performed at final concentrations of 10 nM and 0.1 nM and 0.01 nM. An additional concentration of 0.01 nM was performed for selected duplexes.

Total RNA Isolation Using DYNABEADS mRNA Isolation Kit (Invitrogen, Part #: 610-12):

Cells were harvested and lysed in 150 μl of Lysis/Binding Buffer then mixed for 5 minute at 850 rpm using an Eppendorf Thermomixer (the mixing speed was the same throughout the process). Ten microliters of magnetic beads and 80 μl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 μl Wash Buffer A and mixed for 1 minute. Beads were capture again and supernatant removed.

Beads were then washed with 150 μl Wash Buffer B, captured and supernatant was removed. Beads were next washed with 150 μl Elution Buffer, captured and supernatant removed. Beads were allowed to dry for 2 minutes. After drying, 50 μl of Elution Buffer was added and mixed for 5 minutes at 70° C. Beads were captured on magnet for 5 minutes. 40 μl of supernatant was removed and added to another 96 well plate.

cDNA Synthesis Using ABI High Capacity cDNA Reverse Transcription Kit (Applied Biosystems, Foster City, Calif., Cat #4368813):

A master mix of 2 μl 10× Buffer, 0.8 μl 25×dNTPs, 2 μl Random primers, 1 μl Reverse Transcriptase, 1 μl RNase inhibitor and 3.2 μl of H2O per reaction were added into 10 μl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 μl of cDNA were added to a master mix containing 0.511 GAPDH TaqMan Probe (Applied Biosystems Cat #4326317E), 0.5 μl TFR2 probes, and 5 μl Lightcycler 480 probe master mix (Roche Cat #04887301001) per well in a 384 well 50 plates (Roche cat #04887301001). TFR2 probes were Applied Biosystems cat #Hs02378779_s1 and Hs00162690_m1, respectively. Real time PCR was done in an ABI 7900HT Real Time PCR system (Applied Biosystems) using the ΔΔCt(RQ) assay. Each duplex was tested in two independent transfections and each transfection was assayed in duplicate, unless otherwise noted in the summary tables.

To calculate relative fold change, real time data were analyzed using the ΔΔCt method and normalized to assays performed with cells transfected with 10 nM AD-1955, or mock transfected cells. IC50s were calculated using a 4 parameter fit model using XLFit and normalized to cells transfected with 10 nM AD-1955, mock transfected, or to the average lowest dose.

Table 14 shows the TFR2 dose response data of the duplexes.

Example 20

Activity of TFR2 and HAMP siRNA in Non-Human Primates (NHPs) In Vivo

The efficacy of AD-52590, AD-51707, and AD-48141 was determined in separate cynomolgus monkeys (3 each) using PBS as a control. The sequence of AD-52590, AD-51707, and AD-48141 are shown below and in Table 4, 10B, and 13.

Each siRNA was formulated with AF-011. The siRNAs were administered intravenously as indicated (0.1 mg/kg, 0.03 mg/kg, or 1 mg/kg) via a 15 minute infusion. A single siRNA dose was administered to each monkey. After injection, liver and serum samples were harvested. Liver biopsy samples were taken at 48 hours (h) post-injection. Serum samples were taken at Day -9, Day -6, Day -3, 24 h post-injection, and 48 h post-injection. The liver Hamp mRNA levels were determined by qRT-PCR using Hamp specific primers. The liver TFR2 mRNA levels were determined by qRT-PCR using TFR2 specific primers. Serum iron levels were determined and are shown in μg/dL. Serum HAMP protein levels were also determined and are shown in ng/mL.

Figure 6:
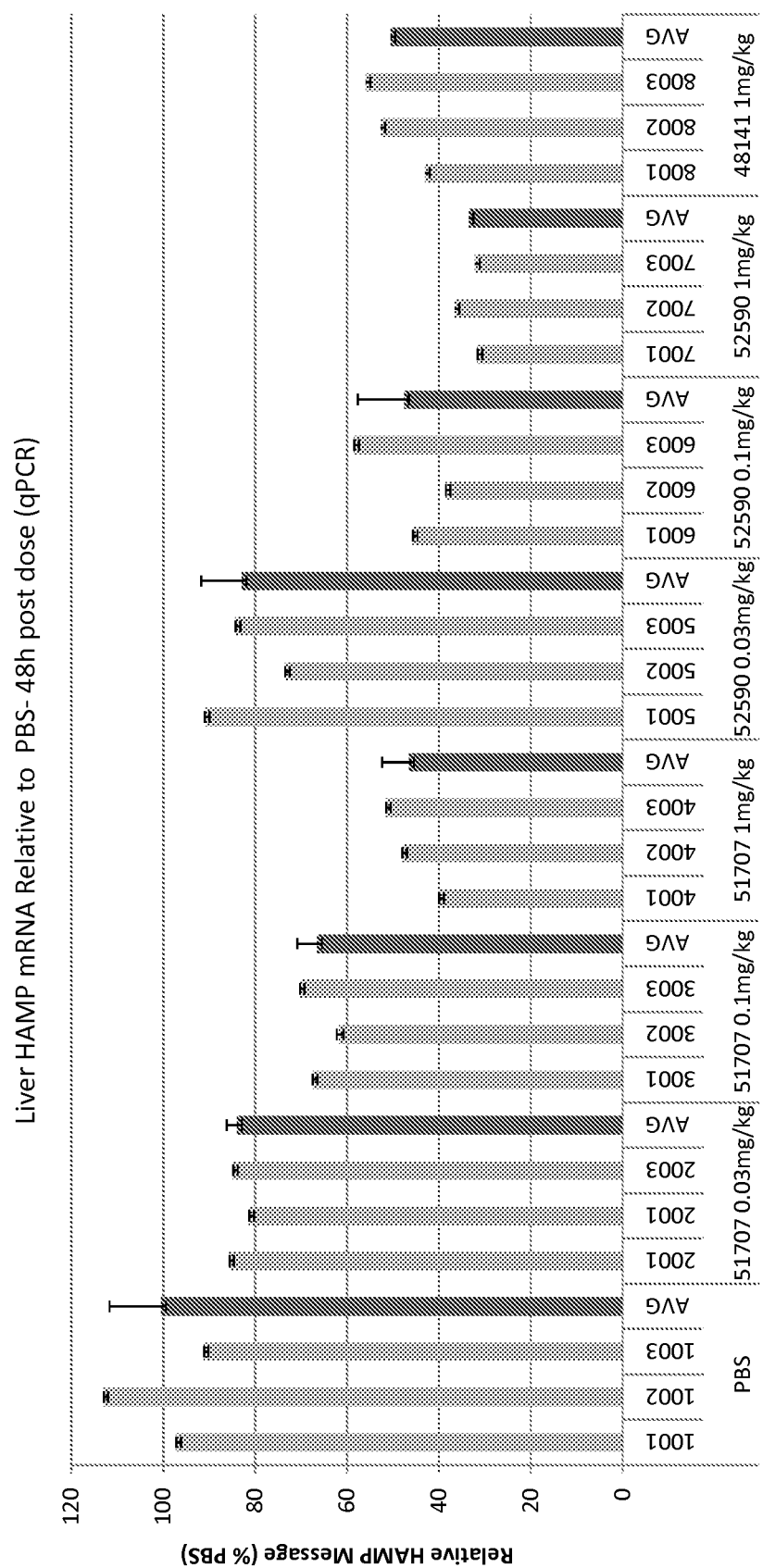
FIG. 6 shows the level of HAMP mRNA reduction in the liver of each animal following siRNA administration, compared to PBS controls.
Figure 7:
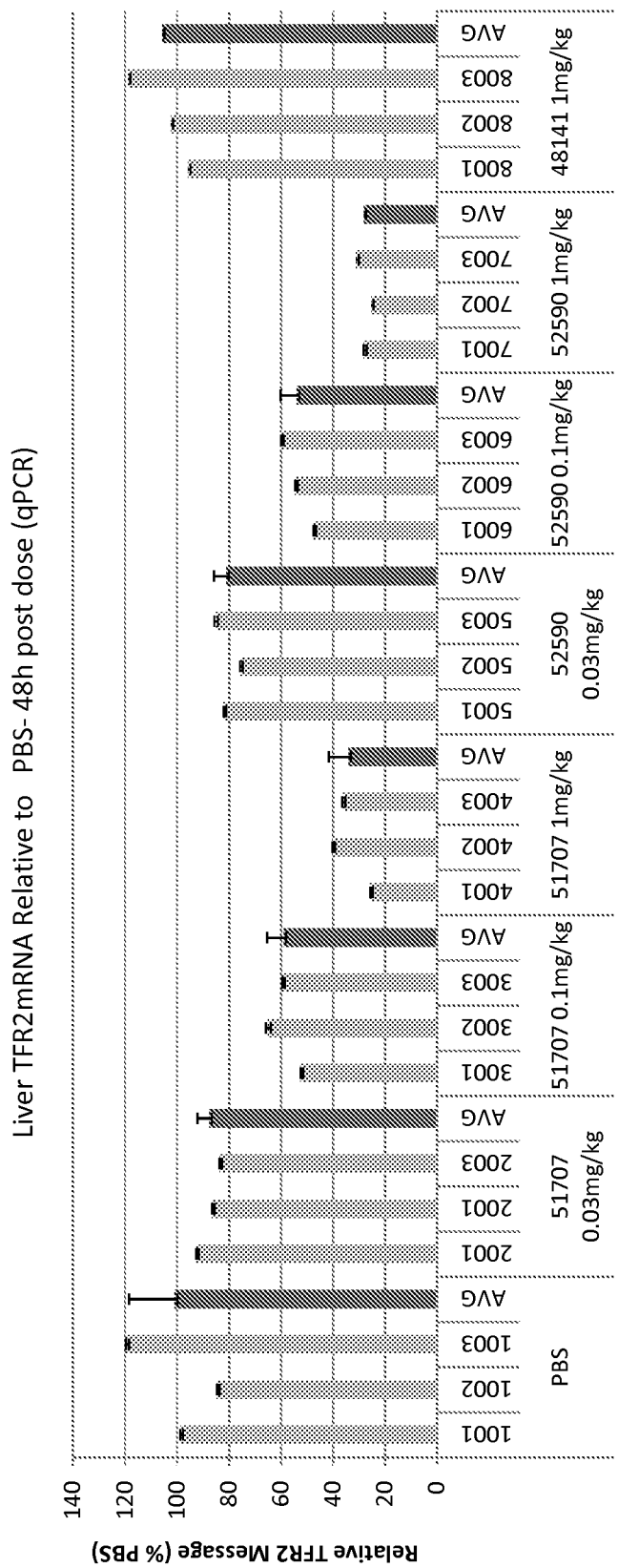
FIG. 7 shows the level of TFR2 mRNA reduction in the liver of each animal following siRNA administration, compared to PBS controls.
Figure 8:
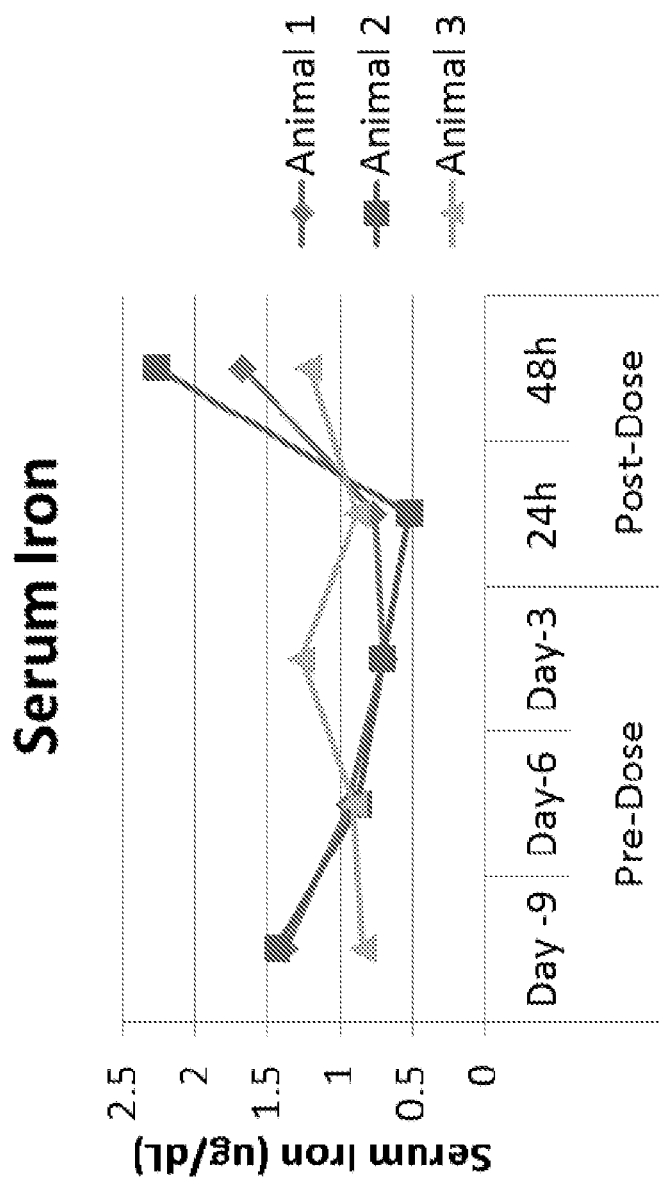
FIG. 8 shows that serum iron concentration was increased in each animal after 1 mg/kg AD-52590 siRNA administration.
Figure 9:
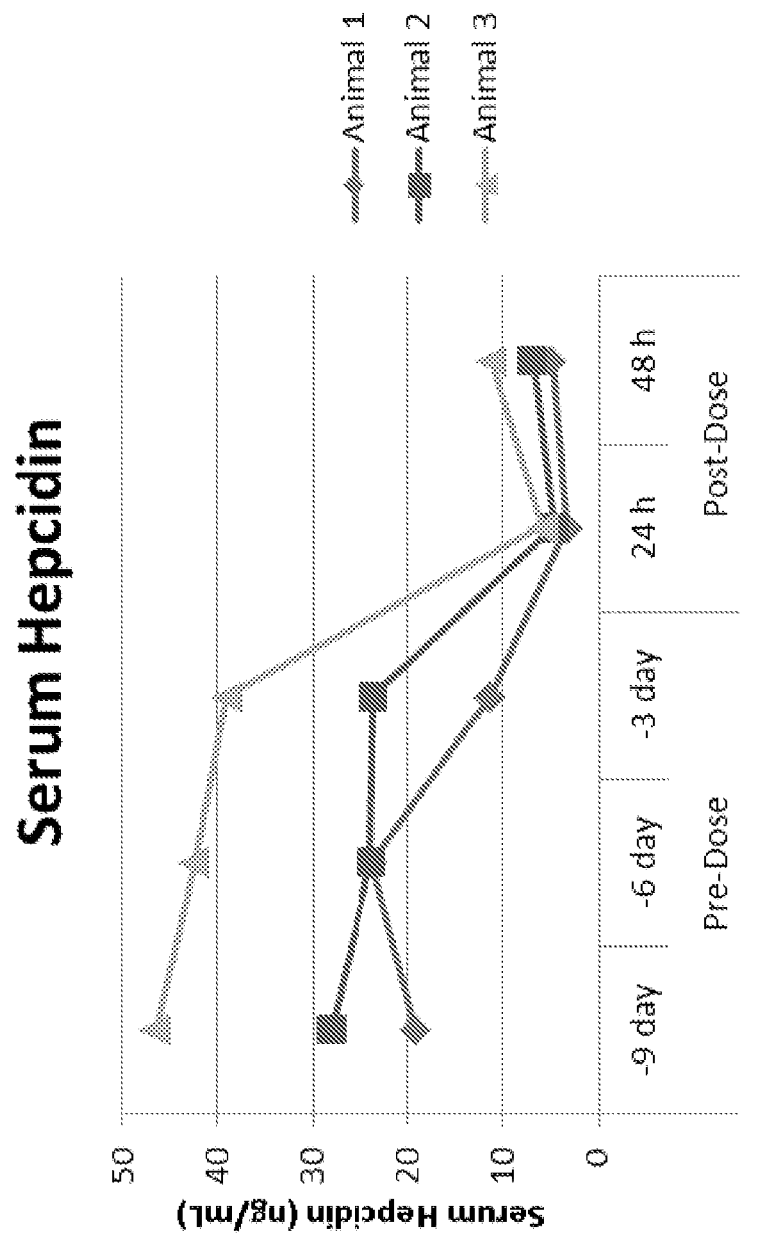
FIG. 9 shows that the HAMP serum protein concentration was decreased in each animal following 1 mg/kg AD-52590 siRNA administration.

FIG. 6 shows HAMP mRNA levels in the liver of each animal following siRNA administration, relative to PBS controls. FIG. 7 shows TFR2 mRNA levels in the liver of each animal following siRNA administration, relative to PBS controls. FIG. 8 shows that serum iron concentration was increased in each animal after 1 mg/kg AD-52590 siRNA administration. FIG. 9 shows that the HAMP serum protein concentration was decreased in each animal following 1 mg/kg AD-52590 siRNA administration.

Single administration of AD-52590 resulted in rapid reduction of hepcidin mRNA and protein levels, TFR2 mRNA levels, and elevation of serum iron levels in NHPs.

Example 21

NEO1 and SMAD4 Duplex Screening

Human/mouse cross-reactive Neo1 and Smad4 siRNAs were screened in primary mouse hepatocytes. Duplexes are shown in Tables 15, 16, 17, and 18.

Cell Culture and Transfections:

Freshly isolated primary mouse hepatocytes (PMH) were transfected by adding 14.8 μl of Opti-MEM plus 0.2 μl of Lipofectamine RNAiMax per well (Invitrogen, Carlsbad Calif. cat #13778-150) to 5 μl of siRNA duplexes per well into a 96-well plate and incubated at room temperature for 15 minutes. 80 μl of primary hepatocyte media containing ~2×10$^4$ PMH cells were then added to the siRNA mixture. Cells were incubated for either 24 prior to RNA purification. Single dose experiments were performed at 10 nM and 0.1 nM final duplex concentration.

Total RNA Isolation Using DYNABEADS mRNA Isolation Kit (Invitrogen, Part #: 610-12):

Cells were harvested and lysed in 150 μl of Lysis/Binding Buffer then mixed for 5 minute at 850 rpm using an Eppendorf Thermomixer (the mixing speed was the same throughout the process). Ten microliters of magnetic beads and 80 μl Lysis/Binding Buffer mixture were added to a round bottom plate and mixed for 1 minute. Magnetic beads were captured using magnetic stand and the supernatant was removed without disturbing the beads. After removing supernatant, the lysed cells were added to the remaining beads and mixed for 5 minutes. After removing supernatant, magnetic beads were washed 2 times with 150 μl Wash Buffer A and mixed for 1

| Target | Duplex ID | Start Position | SEQ ID NO | Sense Sequence | SEQ ID NO | Antisense Sequence |
|---|---|---|---|---|---|---|
| TFR2 | AD-52590 | 239 | 35 | cAGGcAGcCAAAcCuCAuUdTsdT | 38 | AAUGAGGUuUGGCUGcCugdTsdT |
| TFR2 | AD-51707 | 105 | 47 | ccuucAAucAAAcccAGuudTsdT | 48 | AACuGGGUuUGAuUGAAGGdTsdT |
| HAMP | AD-48141 | 382 | 30 | GAAcAuAGGucuuGGAAuAdTdT | 44 | UAuUCcAAGACCuAuGuUCdTdT | minute. Beads were capture again and supernatant removed. Beads were then washed with 150 μl Wash Buffer B, captured and supernatant was removed. Beads were next washed with 150 μl Elution Buffer, captured and supernatant removed. Beads were allowed to dry for 2 minutes. After drying, 50 μl of Elution Buffer was added and mixed for 5 minutes at 70° C. Beads were captured on magnet for 5 minutes. 40 μl of supernatant was removed and added to another 96 well plate.

cDNA Synthesis Using ABI High Capacity cDNA Reverse Transcription Kit (Applied Biosystems, Foster City, Calif., Cat #4368813):

A master mix of 2 μl 10× Buffer, 0.8 μl 25×dNTPs, 2 μl Random primers, 1 μl Reverse Transcriptase, 1 μl RNase inhibitor and 3.2 μl of H2O per reaction were added into 10 μl total RNA. cDNA was generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 μl of cDNA were added to a master mix containing 0.5 μl of mouse GAPDH TaqMan Probe (Applied Biosystems Cat #4352932E), 0.5 μl Neo1 or SMAD4 TaqMan probe (Applied Biosystems cat #Neo 1-Mm00476326_m1 or SMAD4 Mm03023996_m1) and 5 μl Lightcycler 480 probe master mix (Roche Cat #04887301001) per well in a 384 well 50 plates (Roche cat #04887301001). Real time PCR was done in an ABI 7900HT Real Time PCR system (Applied Biosystems) using the ΔΔCt(RQ) assay. Each duplex was tested in two independent transfections and each transfection was assayed in duplicate, unless otherwise noted.

To calculate relative fold change, real time data were analyzed using the ΔΔCt method and normalized to assays performed with cells transfected with 10 nM AD-1955, or mock transfected cells. IC50s were calculated using a 4 parameter fit model using XLFit and normalized to cells transfected with AD-1955 or naïve cells over the same dose range, or to its own lowest dose.

Table 19 shows the percent remaining mRNA remaining for each SMAD4 duplex tested at 0.1 nM and 10 nM. Controls were 10 nM AD-1955, mock transfected. Table 20 shows the percent remaining mRNA remaining for each NEO1 duplex tested at 0.1 nM and 100 nM. Controls were 10 nM AD-1955, mock transfected.

Example 22

In Vivo Combinatorial Use of dsRNAs Targeting HAMP-Related mRNAs

Figure 10:
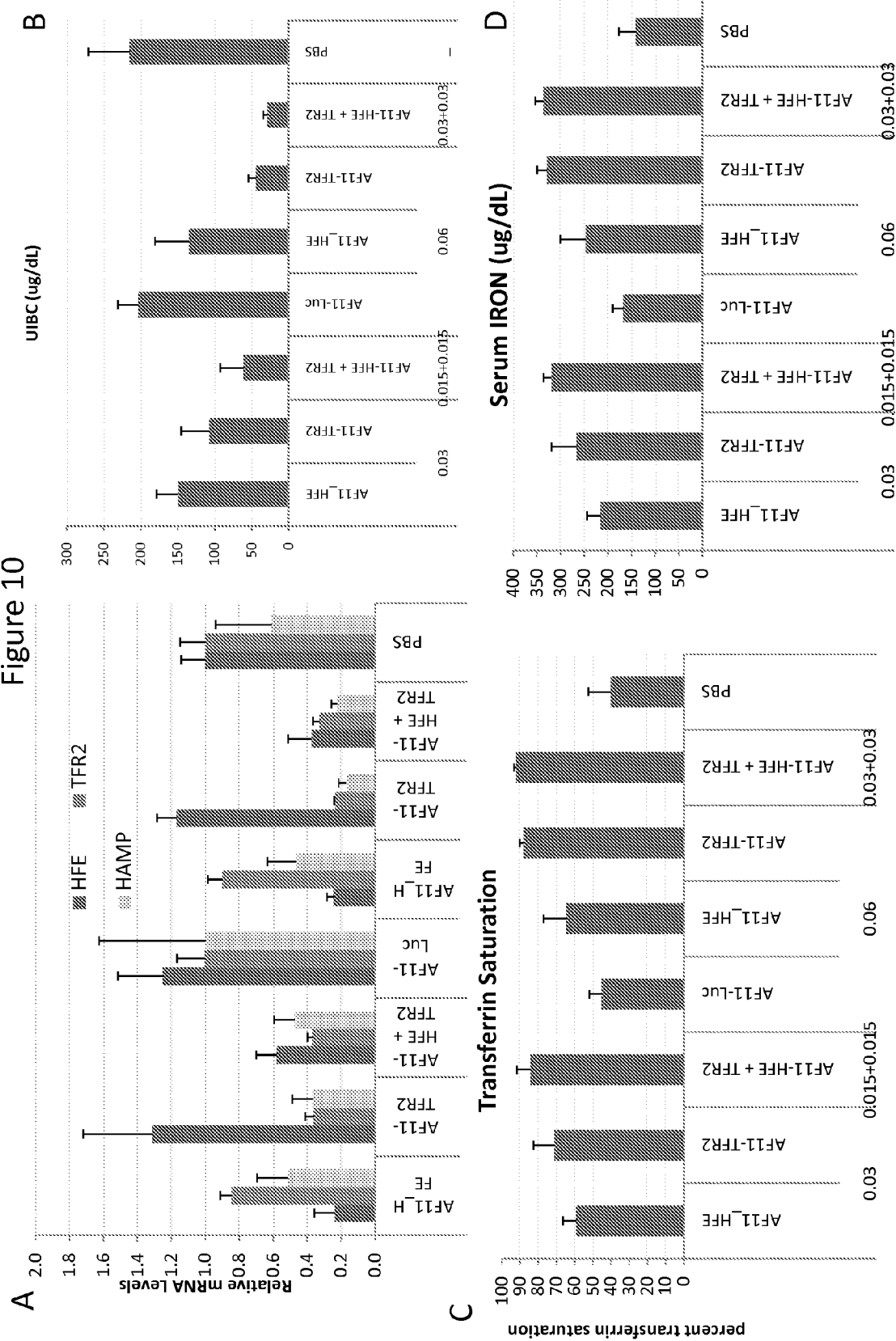
FIG. 10 shows combinatorial use of dsRNAs targeting different HAMP-related mRNAs (HFE and TFR2) in vivo.

The efficacy of TFR2 siRNA AD-47882 and HFE siRNA AD-47320 (see table below for sequences) alone and in combination was determined in C57BL6 female mice using AF-011-Luc siRNA and PBS as controls. Each siRNA was formulated with AF-011. PBS and the siRNAs were administered at various (mg/kg) dosages to the mice as shown on the X-axis of each subfigure (A-D) of FIG. 10. 48 hours after injection, liver and serum samples were harvested from the mice.

| Target | Duplex ID | Accession Number | Sense Sequence | SEQ ID NO | Antisense Sequence | SEQ ID NO |
|---|---|---|---|---|---|---|
| HFE | AD-47320 | NM_010424.4 | uuuucuccAGuuAAG uucAdTsdT | 49 | UGAACUuAACUGGAGA AAAdTsdT | 51 |
| HFE | Unmod AD-47320 | NM_010424.4 | UUUUCUCCAGUUA AGUUCA | 50 | UGAACUUAACUGGAGA AAA | 52 |

The liver Hamp1, HFE, and TFR2 mRNA levels were determined by qRT-PCR using gene specific primers. Blood was processed into serum to measure serum iron, transferrin saturation, and UIBC. FIG. 10A shows the HAMP1, HFE, and TFR2 mRNA levels in mouse liver following various dosages of each siRNA group or PBS. FIGS. 10B-D shows serum iron concentration, transferrin saturation, and UIBC concentration in the serum of each group tested.

Example 23

Inhibition of HAMP in Humans

A human subject is treated with a siRNA targeted to a HAMP gene to inhibit expression of the HAMP gene to treat a condition. In some instances, one or more additional siRNAs are co-administered, e.g., an siRNA targeted to a HFE2, HFE, TFR2, BMPR1a, SMAD4, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 24

Inhibition of HFE2 in Humans

A human subject is treated with a siRNA targeted to a gene to inhibit expression of the HFE2 gene to treat a condition. In some instances, one or more additional siRNAs are co-administered, e.g., an siRNA targeted to a HAMP, HFE, TFR2, BMPR1a, SMAD4, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 25

Inhibition of HFE in Humans

A human subject is treated with a siRNA targeted to a gene to inhibit expression of the HFE gene to treat a condition. In some instances, one or more additional siRNAs are co-administered, e.g., an siRNA targeted to a HAMP, HFE2, TFR2, BMPR1a, SMAD4, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 26

Inhibition of TFR2 in Humans

A human subject is treated with a siRNA targeted to a gene to inhibit expression of the TFR2 gene to treat a condition. In some instances, one or more additional siRNAs are co-administered, e.g., an siRNA targeted to a HAMP, HFE2, HFE, BMPR1a, SMAD4, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 27

Inhibition of BMPR1a in Humans

A human subject is treated with a siRNA targeted to a gene to inhibit expression of the BMPR1a gene to treat a condition. In some instances, one or more additional siRNAs are co-administered, e.g., an siRNA targeted to a HAMP, HFE2, HFE, TFR2, SMAD4, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 28

Inhibition of SMAD4 in Humans

A human subject is treated with a siRNA targeted to a gene to inhibit expression of the SMAD4 gene to treat a condition. In some instances, one or more additional siRNAs are co-administered, e.g., an siRNA targeted to a HAMP, HFE2, HFE, TFR2, BMPR1a, IL6R, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 29

Inhibition of IL6R in Humans

A human subject is treated with a siRNA targeted to a gene to inhibit expression of the IL6R gene to treat a condition. In some instances, one or more additional siRNAs are co-administered, e.g., an siRNA targeted to a HAMP, HFE2, HFE, TFR2, BMPR1a, SMAD4, BMP6, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 30

Inhibition of BMP6 in Humans

A human subject is treated with a siRNA targeted to a gene to inhibit expression of the BMP6 gene to treat a condition. In some instances, one or more additional siRNAs are co-administered, e.g., an siRNA targeted to a HAMP, HFE2, HFE, TFR2, BMPR1a, SMAD4, IL6R, and/or NEO1 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Example 31

Inhibition of NEO1 in Humans

A human subject is treated with a siRNA targeted to a gene to inhibit expression of the NEO1 gene to treat a condition. In some instances, one or more additional siRNAs are co-administered, e.g., an siRNA targeted to a HAMP, HFE2, HFE, TFR2, BMPR1a, SMAD4, IL6R, and/or BMP6 gene.

A subject in need of treatment is selected or identified.

The identification of the subject can occur in a clinical setting, or elsewhere, e.g., in the subject's home through the subject's own use of a self-testing kit.

At time zero, a suitable first dose of an siRNA is administered to the subject. The siRNA is formulated as described herein. After a period of time following the first dose, e.g., 7 days, 14 days, and 21 days, the subject's condition is evaluated. This measurement can be accompanied by a measurement of target gene expression in said subject, and/or the products of the successful siRNA-targeting of mRNA. Other relevant criteria can also be measured. The number and strength of doses are adjusted according to the subject's needs.

Tables

TABLE B

| SEQ ID NO | DESCRIPTION | SEQUENCE |
|---|---|---|
| 1 | Human HAMP - NM_021175.2 | gactgtcactcggtcccagacaccagagcaagctcaagacccagcagtgggacagcc agacagacggcacgatggcactgagctcccagatctgggccgcttgcctcctgctcc tcctcctcctcgccagcctgaccagtggctctgttttcccacaacagacgggacaac ttgcagagctgcaacccaggacagagctggagccagggccagctggatgcccatgt tccagaggcgaaggaggcgagacacccacttcccatctgcattttctgctgcggct gctgtcatcgatcaaagtgtgggatgtgctgcaagacgtagaacctacctgccctgc ccccgtcccctccttccttatttattcctgctgccccagaacataggtcttggaat aaaatggctggttctttcgttttccaaaaaa |
| 2 | Cyno HAMP - EU076443.1 | tcaagacctagcagtgggacagccagacagacggcacgatggcactgagctcccaga tctgggccacttgcctcctcctccttctcctcctcgccagcctgaccagtggctccg ttttcccacaacagacgggacaacttgcagagctgcaacctcaggacagagctggag ccagggccagctggacgcccatgctccagaggcgaaggaggcgagacacccacttcc ccatctgcattttctgctgcggctgctgtcatcgatcaaagtgtgggatgtgctgca ggacgtagaaccttcctgccctgcccccatcccctccttccttatttattcctgct gccccagaacacaggtcttggaataaaacggctgattcttttgttttcc |
| 3 | HAMP - NM_032541.1 | agtccttagactgcacagcagaacagaaggcatgatggcactcagcactcggaccca ggctgcctgtctcctgcttctcctccttgccagcctgagcagcaccacctatctcca tcaacagatgagacagactacagagctgcagcctttgcacggggaagaaagcagggc agacattgcgataccaatgcagaagagaaggaagagagacaccaacttccccatctg catcttctgctgtaaatgctgtaacaattcccagtgtggtatctgttgcaaaacata gcctagagccacatcctgacctctctacaccctgcagcccctcaacccattattt attcctgccctccccaccaatgaccttgaaataaagacgattttattttcaaaaaaa aaaaaaaaaa |
| 4 | Rat HAMP - NM_053469.1 | cacgagggcaggacagaaggcaagatggcactaagcactcggatccaggctgcctgt ctcctgcttctcctcctggccagcctgagcagcggtgcctatctccggcaacagacg agacagactacggctctgcagccttggcatggggcagaaagcaagactgatgacagt gcgctgctgatgctgaagcgaaggaagcgagacaccaacttccccatatgcctcttc tgctgtaaatgctgtaagaattcctcctgtggtctctgttgcataacatagagagcc aagagccttgtcctgacctctcaacacactgcctcccctccgccccattatttattc ctgtcctacccagcaatgaccttg |
| 5 | Human HEFE2 - NM_213652.3 | accgtcaactcagtagccacctccctccctgctcagctgtccagtactctggccagc catatactccccttccccccataccaaaccttctctggttccctgacctcagtgag acagcagccggcctggggacctgggggagacacggaggaccccctggctggagctga cccacagagtagggaatcatggctggagaattggatagcagagtaatgtttgacctc tggaaacactcaccatcatatttaagaacatgcaggaatgcattgatcagaaggtgt atcaggctgaggtggataatcttcctgtagcctttgaagatggttctatcaatggag gtgaccgacctgggggatccagtttgtcgattcaaactgctaaccctgggaaccatg tggagacccaagctgcctacattggcacaactataatcattcggcagacagctgggc agctctccttctccatcaaggtagcagaggatgtggccatggccttctcagctgaac aggacctgcagctctgtgttggggggtgccctccaagtcagcgactctctcgatcag agcgcaatcgtcggggagctataaccattgatactgccagacggctgtgcaagaaag ggcttccagtggaagatgcctacttccattcctgtgtctttgatgctttaatttctg gtgatcccaactttaccgtggcagctcaggcagcactggaggatgcccgagccttcc tgccagacttagagaagctgcatctcttcccctcagatgctggggttcctcttttcct |

TABLE B-continued

| SEQ ID NO | DESCRIPTION | SEQUENCE |
|---|---|---|
| | | cagcaaccctcttagctccactcctttctgggctctttgttctgtggctttgcattc agtaagggaccatcagccccattactagtttggaaatgatttggagatacagattg gcatagaagaatgtaaagaatcattaaaggaagcagggcctaggagacacgtgaaac aatgacattatccagagtcagatgaggctgcagtccagggttgaaattatcacagaa taaggattctgggcaaggttactgcattccggatctctgtggggctcttcaccaatt tttccagcctcatttatagtaaacaaattgttctaatccatttactgcagatttcac ccttataagtttagaggtcatgaaggttttaatgatcagtaaagatttaagggttga gattttttaagaggcaagagctgaaagcagaagacatgatcattagccataagaaact caaaggaggaagacataattagggaaagaagtctatttgatgaatatgtgtgtgtaa ggtatgttctgctttcttgattcaaaaatgaagcaggcattgtctagctcttaggtg aagggagtctctgcttttgaagaatggcacaggtaggacagaagtatcatccctacc ccctaactaatctgttattaaagctacaaattcttcacaccatcaaaaaaaaaaaa aaaaaa |
| 6 | Rhesus HFE2 - XM_001092987.1 | cttctctggctccctgacctcagtgagacagcagccggcctggggacctggggaga catggagaaagagacggaggacccctggctggagctgacccacagagtagggaatc atggctggagaattggatagcagagtaatgtttgacctctggaaacaccaaatttct tttttcagtcacttacagggcttccggtcaaaattcactaggtaggagggtcatcag ctgggaagaaccggcgcctggggaacctggctggataggtatgggggagcaaggcca gtccccctagtcccaggtcctcccatggcagcccccaactctaagcactctcactct cctgctgctcctctgtggacatgctcatcccaatgcaagatcctccgctgcaatgc tgagtatgtatcgtccactctgagcctaggaggtggcggttcatcaggagcacttcg aggaggaggaggaggaggaggccggggtggaggggtgggctctggcggcctctgtcg agccctccgctcctatgcgctctgcactcggcgcaccgcccgcacctgccgtgggga cctcgccttccatccggcggtacatggcatcgaagacctgatgatccagcacaactg ctcgcgccagggccctacagcccctcccccgcccgggcccgcccttccaggcgc aggctccggcctcctgccccggaccccttgtgactatgaaggccggtttccccggct gcatggtcgtcccccgggggttcttgcattgcgcttccttcggggaccccccatgtgcg cagcttccaccaccatttcacacatgccgtgtccaaggagcttggcctctactgga taacgacttcctccttgtccaagccaccagctcccccatggcgttggggggcaacgc taccgctaccggaagctcaccatcatatttaagaacatgcaggaatgcattgatca gaaggtctatcaggctgaggtggataatcttcctgcagcctttgaagatggttctgt caatggaggtgaccgacctgggggatccagtttgtcgattcaaactgctaaccctgg gaaccacgtggagatccaagctgcctacattggcacaactataatcattcggcagac agctgggcagctctccttctccatcaaggtagcagaggatgtggccatggccttctc agctgaacaggacctgcagctctgtgttgggggtgccctccaagtcagcgactctc tcgatcagagcgcagtcgtccgggagctataaccattgatactgccagacggctgtg taaggaagggcttccagtggaagatgcttacttccattcctgtgtctttgatgtttt aatttctggtgatcccaactttactgtggcagctcaggcagcactggaggatgcccg agccttcctgccagacttagataagctgcatctcttcccttcagatgctggggtttc tctttcctcagcaaccttcctagccccactcctttctgggctctttgttctgtggct ttgcattcagtaaggaagccatcagtcctattactagtttggaaatgatttggggat agagattggcatagaagaatgtaaacaatcattaaaggaagcagggcccagaagaca catgaaacaatgacatcatccagagtcagatgaggctgcagtccagggttgaaatga tcacagaataaggattctgggcaaggtttctgcattccagacctcttcgccaaattt tccagccccatttacagtaaacaaattgttctttccatttactgcagatttcaccct ataagcttagaggtcatgaaggttttaacaatcagtaaagacttaagggttgagatt tttaagaggcaagagctgaaagcagaagacatgatcattagccataagaaactcaaa ggaagaagaaataattagggaaagaagtctatttgatgaatatgtgtgtgtaaggta tgttctgctttcttggttcaaaaatgaagcgggcgttgtctagctcttaggtgaagg gagtctctgctttggaagaacggcacaggtaggacagaagtatcatccctaccccta actgatctgttattaaagctacaaattcttcacaccgtc |
| 7 | Mouse HFE2 - NM_027126.4 | ggctctctgacctgagtgagactgcagccattccggggcaatcatggagaaagagat gggggaccccctggctggagcagaccaacagaataggcaactatggctcgagaaccc agtatcagagtaatgcttgacctcgggaaacatcacagaagtacccagagaaattca ctaggtaggaggctcatcatctgggaagaaccggtgcctgggggaccctggctggat aggtatgggccagtccctagtcccggtccccacggcagccctccaactccaag caccctcactctcctgctgctcctctgtggacaggtcactcccagtgcaagatcct ccgctgcaatgccgagtatgtctcgtccactctgagtcttcggggaggtggctcacc ggacacgccgcgtggaggcggccgtggtgggctggcctcaggtggcttgtgtcgcgc cctgcgctcctacgctctctgcacgcggcgcacggcccgcacctgccgcggggacct tgctttccactctgcggtgcatggcatagaggacctgatgatccagcacaactgctc acgccagggtcccacggccccgccccggcccgggccccgccctgccgggggccgg gccagcgcccctgaccccagatccctgtgactatgaggcccggttttccaggctgca cggtcgagcccgggcttcttgcattgcgcatccttggagatccccatgtgcgcag tttccacaaccaatttcacacatgccgtgtccaaggagcttggccctgctagataa cgacttcctctttgtccaggccaccagctcccggtttcgtcgggagccaccgctac caccatccggaagatcactatcatatttaaaaacatgcaggaatgcattgaccagaa agtctaccaggctgaggtggacaatcttcctgcagcctttgaagatggttctatcaa tggggggaccgacctggggggtccgagtttgtccatcaaactgctaaccctgggag tcacgtggagattcgagctgcctacattggaacaactatcatcattcgacagagc tgggcagctctccttctccatcagggtagcagaggatgtggcgcgggccttctccgc agagcaggacctacagctgtgtgttggggatgccctccgagccagcgactctctcg ctcagagcgcaaccgccgtggggctatagccatagatactgccagaaggctgtgtaa ggaagggcttccggttgaagatgcctacttccaatcctgcgtctttgatgtttcagt |

TABLE B-continued

| SEQ ID NO | DESCRIPTION | SEQUENCE |
|---|---|---|
| | | ctccggtgaccccaactttactgtggcagctcagacagctctggacgatgcccgaat cttcttgacggatttagagaacttacatctcttccctcagatgcggggcctcccct ctctcctgccatctgcctagtcccgcttctttcggccctctttgttctgtggctttg cttcagtaagtaggccagcaacccatgactggtttggaaacgatttgaggatagagg ttggtgtgagaaaccacaaagatgtgccaaaggaaacagcggggacaggagacaaca cttacccaatcagatgaggttgcagtccagggctgaaatgaccctagaataaagatt ctgggccagggttttgcactccagaccttggtgtgggctattcaccatggatttccc agttagtgatttcccacttgtaatgaaattccactctccatacacctataccactcc ctacaagcctagagattgtgagagtgctaatgaccagtgaaacattaaaggactgag atatcgtaaaggcaaaaacatgattctctttgagaaagtcaaaagaggagaagctaa ttaggaaaagcttttggttcagaaacgaagtgggcattgtctggcagaggaagtcag cttttggagactggcaccaactcagaaacgggcatttccatcccttcctaatctgtt attaaagcgattagttctccatcctg |
| 8 | Rat HFE2 -<br>NM_001012080<br>.1 | cggggacagacatggagaaggagatggaggaccccctggctggagcagaccaacaga ataggcaactatggctggagaaccgggtatcagagtaatgcttgacctcgggaaaca ccaaatttcttcttccgatcgcagaagtagtactcggcgaaattcactaggtaggag gctcctcatctgggaagaaccggtgcctgggggacctggctggataggtatggggg atcgaggccggtcccctagtctccggtccccccatggcagtcctccaactctaagca ccctcactctcctgctgctcctctgtggacaggctcactcccagtgcaagatcctcc gctgcaatgccgagtacgtctcgtccactctgagccttcggggaggggctcaccgg acacgccacatggaggcggccgtggtgggccggcctcaggtggcttgtgtcgcgccc tgcgctcctacgctctctgcacgcggcgcaccgcccgcacctgccgcggggacctcg cttcccactccgcggtgcatggcatagaggacctgatgatccagcacaactgctcac gccagggtcccacggcctcgcccccggcccggggtcctgccctgcccggggccggcc cagcgcccctgaccccagatccctgtgactatgaagcccggttttccaggctgcacg gtcgaacccccgggtttcttgcattgtgcttcctttggagaccccatgtgcgcagct tccacaatcactttcacacatgccgcgtccaaggagcttggcccctactagataacg acttcctctttgtccaagccaccagctccccggtagcatcgggagccaacgctacca ccatccggaagatcactatcatatttaaaaacatgcaggaatgcattgaccagaaag tctaccaggctgaggtagacaatcttcctgcagcctttgaagatggttctgtcaatg gggcgaccgacctgggggctcgagtttgtccattcaaactgctaaccttgggagcc acgtggagattcgagctgcctacattggaacaactataatcgttcgtcagacagctg gacagctctccttctccatcagggtagcggaggatgtggcacgggccttctctgctg agcaggatctacagctgtgtgttggggatgccctccgagccagcgactctctcgct cagagcgcaatcgccgtggggcgatagccatagatactgccagaaggttgtgtaagg aagggcttccggttgaagatgcctacttccaatcctgcgtctttgatgtttcagtct ccggtgaccccaactttactgtggcagctcagtcagctctggacgatgcccgagtct tcttgaccgatttggagaacttgcacctttcccagtagatgcggggcctcccctct ctccagccacctgcctagtccggcttctttcggtcctcttgttctgtggttttgca ttcagtaagtaggccagcaacccgtgactagtttggaaacggtttgaggagagaggt tgatgtgagaaaacacaaagatgtgccaaaggaaacagtggggacaggagacaacga ccttactcaatcacacgaggttgcagtccagggctgaaatgaccctagaataaagat tctgagacagggttttgcactccagaccttggtatgggctcccccatgaatttcccca ttagtgatttcccacttgtagtgaaattctactctctgtacacctgatatcactcct gcaaggctagagattgtgagagcgctaagggccagcaaaacattaaagggctgagat atcttaaaggcagaaactagaaaaggggaaaccatgattatctctataagaaaatcaaa agaggggtttgggaatttagctcagtggtagagcacttgcctagcaagcgcaaggcc ctgggttcggtccccagctcctaaaaagaaaaaaaaaatcaaaagagaaaaaacta attaaggcaagcttttggttcagaaatgaagtgggcattgtctggcagaggaagtc agcttttggagactggcaccaacatctctcacccttcctactctgttattaaagtgac gaattcccaaaaaaaaaaaaaaaaaaaaaaaaaaaaaagg |
| 9 | Human TFR2 -<br>NM_003227.3 | cgctgggggacagcctgcaggcttcaggaggggacacaagcatggagcggctttggg gtctattccagagagcgcaacaactgtccccaagatcctctcagaccgctctaccagc gtgtggaaggccccggaaagggcacctggaggaggaagaggaagacggggaggagg gggcggagacattgcccacttctgccccatggagctgaggggccctgagcccctgg gctctagacccaggcagccaaacctcattccctgggcggcagcaggacggagggctg ccccctacctggtcctgacggcccctgctgatcttcactgggccttcctactgggct acgtcgccttccgagggtcctgccaggcgtgcggagactctgtgttggtggtcagtg aggatgtcaactatgagcctgacctggatttccaccagggcagactctactggagcg acctccaggccatgttcctgcagttcctgggggaggggcgcctggaggacaccatca ggcaaaccagccttcgggaacgggtggcaggctcggccgggatggccgctctgactc aggacattcgcgcggcgctctcccgccagaagctggaccacgtgtggaccgacacgc actacgtggggctgcaattcccggatccggctcaccccaacaccctgcactgggtcg atgaggccgggaaggtcggagagcagctgccgctggaggaccctgacgtctaccgcc cctacagcgccatcggcaacgtcacgggagagctggtgtacgccactacgggcgc ccgaagacctgcaggacctgcgggccaggggcgtggatccagtgggccgcctgctgc tggtgcgcgtgggggtgatcagcttcgcccagaaggtgaccaatgctcaggacttcg ggctcaaggagtgctcatatacccagagccagcggacttctcccaggacccacccag agccaagcctgtccagccagcaggcagtgtatggacatggcacctgggaactggag acccctacacacctggcttcccttccttcaatcaaacccagttccctccagttgcat catcaggccttcccagcatcccagcccagccatcagtgcagacattgcctcccgcc tgctgaggaagctcaaaggccctgtggcccccaagaatggcaggggagcctcctag gctccccttatcacctgggccccgggccacgactgcggctagtggtcaacaatcaca ggacctccacccccatcaacaacatcttcggctgcatcgaaggccgctcagagccag |

| SEQ ID NO | DESCRIPTION | SEQUENCE |
|---|---|---|
| | | atcactacgttgtcatcggggcccagagggatgcatggggcccaggagcagctaaat
ccgctgtggggacggctatactcctggagctggtgcggacctttcctccatggtga
gcaacggcttccggccccgcagaagtctcctcttcatcagctgggacggtggtgact
ttggaagcgtgggctccacggagtggctagagggctacctcagcgtgctgcacctca
aagccgtagtgtacgtgagcctggacaacgcagtgctgggggatgacaagtttcatg
ccaagaccagcccccttctgacaagtctcattgagagtgtcctgaagcaggtggatt
ctcccaaccacagtgggcagactctctatgaacaggtggtgttcaccaatcccagct
gggatgctgaggtgatccggcccctacccatggacagcagtgcctattccttcacgg
cctttgtgggagtccctgccgccgagttctccttttatggaggacgaccaggcctacc
cattcccgcacacaaaggaggacacttatgagaacctgcataaggcgctgcaaggcc
gcctgcccgccgtggcccaggccgtggcccagctcgcagggcagctcctcatccggc
tcagccacgatcgcctgctgcccctcgacttcggccgctacggggacgtcgtcctca
ggcacatcgggaacctcaacgagttctctgggacctcaagggccgcgggctgaccc
tgcagtgggtgtactcggcgcgggggactacatccgggcggcggaaaagctgcggc
aggagacctacagctcggaggagagagacgagcgactgacacgcatgtacaacgtgc
gcataatgcgggtggagttctacttcctttcccagtacgtgtcgccagccgactccc
cgctccgccacatcttcacgggccgtggagaccacacgctgggcgccctgctggacc
acctgcggctgctgcgctccaacagctccgggaccccgggggccacctcctccactg
gcttccaggagagccgtttccggcgtcagccagccctgctcacctggacgctgcaag
gggcagccaatgcgcttagcggggatgtctggaacattgataacaacttctgaggcc
ctggggatcctcacatccccgtccccagtcaagagctcctctgctcctcgcttgaa
tgattcagggtcagggaggtggctcagagtccacctctcattgctgatcaatttctc
attaccctacacatctctccacggagcccagacccagcacagatatccacacacc
ccagccctgcagtgtagctgaccctaatgtgacggtcatactgtcggttaatcagag
agtagcatcccttcaatcacagccccttcccttctgggggtcctccatacctagag
accactctgggaggtttgctaggccctgggacctggccagctctgttagcgggagag
atcgctggcaccatagccttatggccaacaggtggtctgtggtgaaaggggcgtgga
gtttcaatatcaataaaccacctgatatcaataagccaaaa |
| 10 | Human TFR2 - NM_001206855.1 | ccctgccctggcgaccccacgtctctggcatccctccctcttccctccctctcctc
cgggcgcccagaaaagtccccacctctcccccgcttaggcaaaccagccttcgggaac
gggtggcaggctcggccgggatggccgctctgactcaggacattcgcgcggcgctct
cccgccagaagctggaccacgtgtggaccgacacgcactacgtggggctgcaattcc
cggatccggctcaccccaacaccctgcactgggtcgatgaggccgggaaggtcggag
agcagctgccgctggaggaccctgacgtctactgccccacagcgccatcggcaacg
tcacgggagagctggtgtacgcccactacgggcggcccgaagacctgcaggacctgc
gggccaggggcgtggatccagtgggccgctgctgctggtgcgcgtggggtgatca
gcttcgcccagaaggtgaccaatgctcaggacttcggggctcaaggagtgctcatat
acccagagccagcggacttctcccaggacccaccckaagccaagctgtccagccagc
aggcagtgtatggacatgtgcacctgggaactggagacccctacacacctggcttcc
cttccttcaatcaaacccagttccctccagttgcatcatcaggccttcccagcatcc
cagcccagccatcagtgcagacattgcctcccgcctgctgaggaagctcaaggcc
ctgtggcccccaagaatggcaggggagcctcctaggctcccttatcacctgggcc
ccggggccacgactgcggctagtggtcaacaatcacaggacctccacccccatcaaca
acatcttcggctgcatcgaaggccgctcagagccagatcactacgttgtcatcgggg
cccagagggatgcatggggcccaggagcagctaaatccgctgtggggacggctatac
tcctggagctggtgcggaccttttcctccatggtgagcaacggcttccggccccgca
gaagtctcctcttcatcagctgggacggtggtgactttggaagcgtgggctccacgg
agtggctagaaggctacctcagcgtgctgcacctcaaagccgtagtgtacgtgagcc
tggacaacgcagtgctgggggatgacaagtttcatgccaagaccagcccccttctga
caagtctcattgagagtgtcctgaagcaggtggattctcccaaccacagtgggcaga
ctctctatgaacaggtggtgttcaccaatcccagctgggatgctgaggtgatccggc
ccctacccatggacagcagtgcctattccttcacggcctttgtgggagtccctgccg
tcgagttctcctttatggaggacgaccaggcctaccattcctgcacacaaaggagg
acacttatgagaacctgcataaggtgctgcaaggccgcctgcccgccgtggcccagg
ccgtggcccagctcgcagggcagctcctcatccggctcagccacgatcgcctgctgc
ccctcgacttcggccgctacggggaccgtcgtcctcaggcacatcgggaacctcaacg
agttctctggggacctcaagggccgcgggctgaccctgcagtgggtgtactcggcgc
gggggactacatccgggcggcggaaaagctgcggcaggagatctacagctcggagg
agagagacgagcgactgacacgcatgtacaacgtgcgcataatgcgggtggagttct
acttcctttcccagtacgtgtcgccagccgactcccgttccgccacatcttcatgg
gccgtggagaccacacgctgggcgccctgctggaccacctgcggctgctgcgctcca
acagctccgggaccccgggggccacctcctccactggcttccaggagagccgtttcc
ggcgtcagctagccctgctcacctggacgctgcaaggggcagccaatgcgcttagcg
gggatgtctggaacattgataacaacctctgaggccctggggatcctcacatccccg
tccccagtcaagagctcctctgctcctcgcttgaatgattcagggtcagggaggtg
gctcagagtccacctctcattgctgatcaatttctcattaccctacacatctctcc
acggagcccagaccccagcacagatatccacacaccccagccctgcagtgtagctga
ccctaatgtgacggtcatactgtcggttaatcagagagtagcatcccttcaatcaca
gccccttcccttctgggttcctccatacctagagaccactctgggaggtttgcta
ggccctgggacctggccagctctgttagcgggagagatcgctggcaccatagccta
tggccaacaggtggtctgtggtgaaaggggcgtggagtttcaatatcaataaaccac
ctgatatcaataagccaaaa |

TABLE B-continued

| SEQ ID NO | DESCRIPTION | SEQUENCE |
|---|---|---|
| 11 | Rhesus TFR2 - XM_001113151.2 | accccaggacctgcgctcagggagcaggcaggtgtggggctgtggagagattggcag gggagagcacagccgcttgtgctctggcctggactcaggggccacgtctggaaggtt ggaccgaggccaggactgtgcccccacccttgggggtggtaaggagcagccttggct caggctttctgccagggctgataaggagccctcctgggcctcccacaaacggtttat cggtttatcactggggacagcctgcaggcttcaggaggggcacaagcatggagcag ctttggggtctactccagagagcgcaacaactgtccccaagatcctctcagaccgtc taccagcgtgtggaaggccccagaaagggcacctggaggaggaagaggaagacggg gaggagacactggcccacttctgccccatggagctgaagggccctgagccctgggc tctagacccaggcagccaaacctcattccctgggcagcagcaggacggagggctgcc ccctacctggtcctgactgctctactgatcttcactggggccttccttctgggctac gtcgccttccgagggtcctgccagacatgcggagactccgtgttggtggtcagtgag gacgtcaactatgagcctgacctggatttccaccggggcacactgtactggagcgac ctccaggccatgttcctgcagttcccggggagggggcgcctggaggacaccatcagg caaaccagccctcgggaacgggtggcaggctcggccgggatggccgctctgactcag gatatccgcgcggcgctctctcgccagaaactggaccacgtgtggaccgacacgcac tacgtggggctgcaattcccggacccggctcacccccaacaccctgcactgggtcgat gaggccgggaaggtcggagagcagctgccgctagaggaccctgacgtctactgcccc tacagcgccatcggcaacgtcacgggagagctggtgtacgccactacgggcggccc gaagacctgcaggacctgcgggcaggggcgtggacccagcgggccgcctgctgcta gtgcgcgtgggggtgatcagcttcgcccagaaggtgaccaatgctcaggacttggg gctcaaggagtgctcatatacccagagccagcggacttctcccaggacccacacaag ccaagcctgtccagccagcaggctgtgtatggacatgtgcacctgggaactggagac ccctacacgcctggcttcccttccttcaatcaaacccagttccctccagttgcatca tcgggccttcccagcatcccagcccagccatcactgcagacattgcctcccgcctg ctgaggaagctcaaaggccctgcggcccccaggaatggcaggggaggagcctcctaggc tcccttatcacctgggccccgggccacgactgcggctagcggtcaacaaccacagg acctccacccccatcaacaacatctttggctgcatcgaaggccgctcagagccagat cactatgttgtcatcggggcccagagggatgcgtggggcccaggagcagctaaatcc gctgtggggacagctatactcctggagctggtgcggaccttttcctccatggtgagc aacggcttccggccccgcagaagtctcctcttcatcagctgggatggcggtgacttt gggagcgtgggctccacagagtggctagagggctacctcagtgtgctgcacctcaaa gctgtagtgtacgtgagcctggacaacgcagtgccggggggatgacaagtttcatgcc aagaccagccccttctgacaagtctcattgagagtgtcctgaaacaggcaagagca cccaggaatggctgaccctgcagtgggtgtactccgcgcggggggactacatccgg gcggcgagaagctgcggcaggagatctacagctcggaggagagagacgagcgactg acacgcatgtacaacgtgcgcataatgcgggtggagttctacttcctttcccagtac gtgtcgccggccgactccccgttccgccacatcttcatgggccgcggagaccacacg ctgggcgccctgctgaccacctgcggctgctgcgctccaacagctccgggacccc ggggccacctcctccgccgtcttccaggagagtcgcttccggcgtcagctagccctg ctcacctggacgctgcaaggggcagccaatgcgcttagcggggacgtctggaacatt gataacaacttctgagaccctggggatcctcagatccccctgtcccttgtcgagag ctcctctgctcctcgcttcaatgattcagggtcagggaggtggctcagagtccacct ctcattgctgatcgacttctcattaccccctacacgtctctccacggagcccagactg cagcacagatatccacacaccccagccctgcagtgtagctgactctaatgtgatggt catactgtcggttaatcagagagcagtatcccttcaatcacaacccctttcccttc tggggtcctccataccttagagactaggccttgggacctggccagctctcttagcggg agagatcgctggcaccatagcccttatggccaacaggtggtctgtggtgaaagggca tggagtttcaatgtc |
| 12 | Mouse TRF2 - NM_015799.3 | gagcatggtccaagaaacccagagacctgttgctgagctgaacttggctgctgtgtc ttcccactcaggactcggctttgacagctgcaggtcctggtgtcttcgtcgcggctt ggatttcaaactggaggagttcaggaggggcacaagcatggagcaacgttggggtc tacttcggagagtgcaacagtggtccccaagaccctctcagaccatctacagacgcg tggaaggccctcagctggagcacctggaggaggaagacagggaggaagggcggagc ttcctgcccagttctgccccatggaactcaaaggccctgagcacttaggctcctgtc ccgggaggtcaattcccatacccctgggctgcagcaggtcgaaaggctgcccctatc tggtcctgatcaccctgctaatcttcactggggccttcctcctaggctacgtggcct ttcgagggtcctgccaggcgtgtggggactccgtgttggtggtcgatgaagatgtca accctgaggactccgccggaccacgttgtactggagcgacctccaggccatgttttc tccggttccttggggaggggcgcatggaagacaccatcaggctgaccagcctccggg aacgcgtggctggctcagccagaatggccaccctggtccaagatatcctcgataagc tctcgcgccagaagctggaccacgtgtggactgacacgtgggacttcagt tcccagatccggctcacgctaacaccctgcactgggtggatgcagacgggagcgtcc aggagcagctaccgctgaaggatccggaagtctactgccccctacagcgccaccggca acgccacgggcaagccggtgtacgccactacggggcggtcggaggacctacaggacc taaaagccaagggcgtggagctggccggcaggcctcctgctagcgcgagttggaatta ctagcttcgcccagaaggtagccgttgcccaggactttgggggctcaaggagtgctga tatcccctgacccatcagacttctcccaggatcccacaagccaggcctgtctagcc accaggctgtgtacggacatgcgcacctgggaactggagacccttacacacctggct tcccgtccttcaatcaaacccagttccctccagtagaatcatcaggccttcccagca tccccgcccagcccatcagtgctgacattgctgaccaattgctcaggaaactcacag gccccgtggctcccaggagtggaaaggtcacctctcaggctctccttatcggctgg gacctgggcccgacttacgccttgtggtcaacaaccacagagtctctaccccatca gtaacatctttgcgtgcatcgagggctttgcagagccagatcactatgttgtcattg gggcccagagggatgcatgggccaggagcagccaagtctgcagtggggactgcca |

TABLE B-continued

| SEQ ID NO | DESCRIPTION | SEQUENCE |
|---|---|---|
| | | tcctgctggagctggttcggaccttctcttccatggtcagcaatgggttcagacctc<br>gaagaagtcttttgttcatcagctgggacggaggtgactttggcagcgtgggagcca<br>cagagtggttggagggctacctcagcgtgctacacctcaaagctgttgtgtacgtga<br>gcctggacaactccgtgttgggagatggcaaattccatgctaagaccagccccttc<br>tcgtcagcctcattgagaatatcttgaagcaggtggactccctaaccatagtggac<br>agaccctctatgaacaagtggcactcacccaccccagctgggatgctgaagtgattc<br>agccctgcccatggacagcagtgcatattccttcacagcctttgcgggggtcccag<br>ccgtggagtcctccttcatggaggacgatcgggtgtacccattcctgcacacgaagg<br>aggacacatacgagaatctgcacaagatgctgcgaggtcgcccgcccgccgtggtcc<br>aggcagtggctcagctcgcgggccagctcctcatccgactgagccacgatcacctac<br>tgccgctagacttcggccgctatggagacgcggttctcaggcacatcggcaacctca<br>atgagttctctggggacctcaaggagcgcgggctgaccctgcagtgggtgtactctg<br>caagggggactacatccgtgccggcggaaaagctgcggaaggagatttacagctcgg<br>agcggaacgatgagcgtctgatgcgcatgtacaacgtgcgcatcatgagggtggagt<br>tctacttcctgtcccagtatgtgtcgccagccgactccccattccgccacattttcc<br>taggccaaggcgaccacactttgggtgccctggtagaccacctgcggatgctgcgcg<br>ccgatggctcaggagccgcctcttcccggttgacagcaggtctgggcttccaggaga<br>gtcgcttccggcgccagctggcgctgctcacctggacactgcaggggcagccaacg<br>ctctcagtggcgacgtttggaacattgacaataacttttgaagccaaaagccctcca<br>tgggccccacgtgattctcctttctccctctttgagtggtgcaggcaaaggaggcgc<br>ctgagattgtaacctattcttaacacccttggtcctgcaatgctggtgcgccatatt<br>ttctcagtgtggttgtcatgccgttgcttacccagaaagcggttttcttcccatcac<br>aggcccttctgtcttcaggagcaaagttccccatatctagagactatctagatgctg<br>ggatctgatcagctctcttagagagtgagatggacagcgtcattattttatgacaca<br>tgagctacggtatgtgagcagcccaaggggattagatgtcaataaaccaattgtaac<br>ccctgttgtccatacgcaa |
| 13 | Rat TFR2 - NM_001105916.1 | aaatccagagacctgttgctgagttgaacttggctgctgtgtcttcccactcaggac<br>tcggctttgacagacacgaggcagggactggggtgagccccctacctctcagatcttt<br>ctggacctggctgcgggtcctgggatcttcagcgcggcttggatttcaaactggagg<br>ggttcaggaggggcacaagcatggaacaacgttggggtctacttcggaaagtgcaa<br>cagtggtccccaagaccctctcagaccatctacagacgtgtggaaggccctcaactg<br>gagaacctagaggaggaagatagggaggaaggggaggagcttcctgcccagttctgc<br>cccatggaactcaaaggccctgagcgcttaggctcctgtcctgggaggtccattccc<br>atacccctgggctgcagcaggtcgaaaggctgctccctatctggtcctgaccaccctg<br>ctaatcttcactggggccttcctcctgggctacgtggcctttcgagggtcctgccag<br>gcatgtggggactctgtgttggtggttggtgaagatgtcaactctgaggactccagc<br>cggggcacgttgtactggagtgacctccaggacatgtttctccggttccttgggag<br>ggacgcatggaggacaccatcaggctgaccagcctccgggaacgcgtggccggctca<br>gccagaatggccaccctggtccaagacatcctcgataagctctcgcgccagaagctg<br>gaccacgtgtggactgacacgcactatgtgggacttcagttcccggacccggctcac<br>cctaacaccctgcactgggtgggtgcagacgggagcgtccaagagcagctaccgctg<br>gaggatccggaagtctactgtccctacagcgccacgggcaacgccacgggcaagctt<br>gtgtacgcccactacgggcggcgggaggacctgcaggacctgaaagccaaggacgtg<br>gagctggccggcagcctcctgctagtgcgcgctgggattacaagcttcgcccagaag<br>gtagccattgcccaggactttggggcccacggagtgctgatatacctgacccagcg<br>gacttctcccaagaccccacaagccaggcctgcctagtgacagggctgcgtatgga<br>catgtgcacctgggaactggggacccttacacgcctggcttcccgtccttcaatcaa<br>acccagttccctccagtagaatcatcggggcttcccaacatccctgcccagcccatc<br>agtgccgacgttgctgatcgcttgctcaggaaactcacaggtccgtggctcctcag<br>gaatggaagggtcgcctctcagactctccgtatcgcctgggacctgggccaggctta<br>cgccttgtggtcaacaaccacagaacctctactcccatcagtaacatctttgcgtgc<br>atcgagggcttcgcagagccagatcactatgtcgttatcggggcccagagggatgcc<br>tgggccccaggagcagccaagtctgcagtggggactgccatcctcctggagctggtt<br>cggaccttttcctccatggtcagcagtggcttttagacctcgaagaagtcttttgttc<br>atcagctgggacggaggtgactttggcagcgtgggagccacggagtggttggagggc<br>tacctcagcgtgctacacctcaaagctgtcgtgtatgtgagcctggacaactccgtg<br>ttgggagacggcaaattccatgctaagaccagccccttctcgtcagcctcattgag<br>aatatcctgaagcaggtggattcccctaaccacagtggacagacactctacgatcaa<br>gtggcattcacccaccccaagctgggatgctgaagcgatccagcccctgcccatggac<br>agcagcgcatattccttcacagcttttgcgggcgtcccagctgtggagttctccttc<br>atggaggacgatagggtgtacccattcctgcacacgaaggaggacacgtatgagaat<br>ctgcacaagatgctgcgaggtcgcctgcccgccgtggtcctagcagtggctcagctc<br>gctggtcagctcctcatccgactgagccacgatcacctactgccgctggacttcggc<br>cgctacggagacgtggtcctcaggcacatcggcaacctaatgagttctctggggac<br>ctcaaggcgcgcgggctgaccctgcagtgggtgtactctgcaagggggactatatc<br>cgggcggcggagaagctgcggaaggagatttacagctcggagcagagcgatgagcgt<br>ctgatgcgcatgtacaacgtgcgcatcatgagggtggagttctacttcctgtcccag<br>tacgtgtccgcggccgactccccattccgccacattttcctaggccaaggcgaccac<br>actttgggtgccctggtggaacacctacggatgctgcgctccgatggctcaggagct<br>gcctcttctgggttgagcccaggtctggcttccaggagagtcgcttccggcgacag<br>ctggcgctgctcacgtggacgctacaggggcagccaacgcactcagtggcgacgtt<br>tggaacatcgacaataacttttgaggccagaagtcctccatgggcccacgtgattc<br>tcctttctccctatttgagtggtgcaggcaacgcgaggtgcctgagagcaacctatcc<br>tcattaacaaccttggtcctgcaacgccagtgagacatattttctcagtgtgactgt<br>tataccactgtttatccagaaaagcggttttcttcccatcactggcctctctgccttc |

TABLE B-continued

| SEQ ID NO | DESCRIPTION | SEQUENCE |
|---|---|---|
| | | aggagcatagttccccatatctagaaaccatctagacactgggatccagctctctta gcgggtgagatggatagcgtcatttccttatgacacacaagtggtatgtgggtggcc caaggggggattagatgtcaataaaccatttacctggtaacctctgttgtccataagc |
| 14 | Human HFE - NM_139006.2 | ctaaagttctgaaagacctgttgcttttcaccaggaagttttactgggcatctcctg agcctaggcaatagctgtagggtgacttctggagccatccccgtttccccgccccc aaaagaagcggagatttaacggggacgtgcggccagagctggggaaatgggcccgcg agccaggccggcgcttctcctcctgatgcttttgcagaccgcggtcctgcaggggcg cttgccgcgttcacactctctgcactacctcttcatgggtgcctcagagcaggacct tggtctttccttgtttgaagctttgggctacgtggatgaccagctgttcgtgttcta tgatcatgagagtcgccgtgtggagcccgaactccatgggtttccagtagaatttc aagccagatgtggctgcagctgagtcagagtctgaaagggtgggatcacacgttcac tgttgacttctggactattatggaaaatcacaaccacagcaaggagtcccacaccct gcaggtcatcctgggctgtgaaatgcaagaagacaacagtaccgagggctactggaa gtacgggtatgatgggcaggaccaccttgaattctgccctgacacactggattggag agcagcagaacccagggcctggcccaccaagctggagtgggaaaggcacaagattcg ggccaggcagaacagggcctacctggagagggactgccctgcacagctgcagcagtt gctggagctggggagaggtgttttggaccaacaagtgaccactctacggtgtcgggc cttgaactactaccccagaacatcaccatgaagtggctgaaggataagcagccaat ggatgccaaggagttcgaacctaaagacgtattgcccaatggggatgggacctacca gggctggataaccttggccgtacccctggggaagagcagagatatacgtgccaggt ggagcacccaggcctggatcagcccctcattgtgatctgggagccctcaccgtctgg caccctagtcattggagtcatcagtggaattgctgttttttgtcgtcatcttgttcat tggaatcttgttcataatattaaggaagaggcagggttcaagaggagccatggggca ctacgtcttagctgaacgtgagtgacacgcagcctgcagactcactgtgggaaggag acaaaactagagactcaaagagggagtgcatttatgagctcttcatgtttcaggaga gagttgaacctaaacatagaaattgcctgacgaactccttgattttagccttctctg ttcatctcctcaaaaagatttccccatttaggtttctgagttcctgcatgccggtga tccctagctgtgacctctcccctggaactgtctctcatgaacctcaagctgcaccta gaggcttccttcatttcctccgtcacctcagagacatacacctatgtcattttcattt cctattttggaagaggactccttaaatttgggggacttacatgattcattttaaca tctgagaaaagctttgaaccctgggacgtggctagtcataaccttaccagattttta cacatgtatctatgcattttctggacccgttcaacttttcctttgaatcctctctct gtgttacccagtaactcatctgtcaccaagccttggggattcttccatctgattgtg atgtgagttgcacagctatgaaggctgtacactgcacgaatggaagaggcacctgtc ccagaaaaagcatcatggctatctgtgggtagtatgatgggtgttttagcaggtag gaggcaaatatcttgaaagggtgtgaagaggtgttttttctaattggcatgaagg tgtcatacagatttgcaaagtttaatggtgccttcatttgggatgctactctagtat tccagacctgaagaatcacaataatttctacctggtctctccttgttctgataatg aaaattatgataaggatgataaaagcacttacttcgtgtccgactcttctgagcacc tacttacatgcattactgcatgcacttcttacaacaattctacgagataggtactat tatccccatttctttttttaaatgaagaaagtgaagtaggccgggcacggtggctcac gcctgtaatcccag |
| 15 | Rhesus HFE - XM_001085598.2 | ttttactgggcatctcctgagcctaggcaatagctgtagggtgacttctggagccat cgccgtttccccgccccaccaaagaagcggagactt aaagggggacgtgcagtcagag ctggggaaatgggcccgcgagccaggccggcgcttctcctcctgatgcttttgcaga ccgcggtcctgcaggggcgcttgctgcgttcacactctctgcactacctcttcatgg gttcctcagagcaggaccttggtctttccctgtttgaagctttgggctatgtggacg accagctgttcgtgttccatgatcacgagagtcgccgtgtggagcccgaactccat gggtttccggtagaacgtcaagccagatgtggctgcagctgagtcagagtctgaaag ggtgggatcacatgttcactgttgacttctggactattatggaaaatcacaaccaca gcaaggagtcccacaccctgcaggtcatcctgggctgcaaaatgcaagaggacaaca gtaccgagggcttctggaagtacgggcacgatgggcaggaccaccttgaattctgcc ctgacacactggattggagagcagcagaacccagggcctggcccaccaagctggagt gggaaaggcacaaaattcgggccaggcagaacagggcctacctcgagagggactgcc ctgtgcagctcagcagttgctggagctggggagaggtgttttcgaccggccagtga ccactctacggtgtcgggccctgaactactaccccagaacatcaccatgaagtggc tgaaggataggcagtcaatggatgccaaggaggtcgaacctaaagacgtattgccca atggggatgggacctaccagggctggataaccttgactgtaccccaggggaagaac agagatatacttgccaggtggagcacccaggcctggatcagcccctccttgctttct gggagccctcaccatctagaactctagtcattggagtcatcagtggaattgctgttt ttgtcatcatcttgttcattggaattttgttcataatattaaggaagaggcagactt caagaggagtcatggggcactacgtcttagctgaacgtgagtgacacg |
| 16 | Mouse HFE - NM_010424.4 | ctgagaggtctggaacctcagcaatggctacagggtgacttcttggatcctccacgt ttccagatcctagtgaagaccggtggaccccagctgaggacatgacgtgcagtcactgg gctccctgtgcggcgctgctgctgctgctgctactgctgtggtccgtggccccgca ggcactgccaccgcgttcacattctccaagatacctcttcatgggtgcctcagagcc agacctcgggctgcctttgtttgaggctaggggctatgtggatgaccagctctttgt gtcctacaatcatgagagtcgccgtgtgctgagcccaggccccgtggatcttggagca aacctcaagccagctgtggctgcatctgagtcagagcctgaaagggtgggactacat gttcatagtagacttctggaccatcatgggcaactataaccacagtaaggtcacgaa gttgggagtggtgtccagtcccacatcctgcaggtggtcctaggctgtgaggtgca tgaagacaacagtaccagcggcctctggagatatggttatgacgggcaagatcacct ggaattctgccccaagacactaaactggagcgcagccgagccaggggcctgggccac |

TABLE B-continued

| SEQ ID NO | DESCRIPTION | SEQUENCE |
|---|---|---|
| | | caaggtggaatgggacgagcacaagatccgtgccaaacagaacagggactacctgga gaaggactgccccgagcagctgaaacggctcctggagctggggagaggcgttctggg acagcaagtgcctactttggtgaaagtgactcgccactgggcctctacggggacctc tctaaggtgtcaggctctggacttcttccccagaacatcactatgaggtggttgaa ggacaaccaaccactggatgccaaagatgtcaaccccgagaaggtgctacctaacgg ggatgagacctatcaaggctggctgacattggccgtggcccctggggacgagacaag gttcacctgtcaagtggagcacccaggcctggaccagcctctcactgcctcttggga gcccttgcaatctcaggccatgattatcggaatcatcagtggagtcaccgtctgtgc catctccttggttggaattctgttcctaatcttaaggaaaaggaaggcttcaggagg aaccatgggtggctatgtcttaacagactgtgagtgatctgcagcctgctgaaccac ggaagagagaaaactcagccaaagacttggaggggcacacttgctccactgtagga cacagttggacctaacacacagaaactgcctgagaactgtgctcttagctttctctg ttcactttcttaaggtgttttctccagttaagttcagttcctgaatagtagtgattg caccagttgcaacctctccctccagaactggtctcatgattcttaggctgcttcttg gaagcatcctatgtttccttcatgcacctagactccatatgtctacgtaaagagccc ctctaagtttagtggatacatgattcgtttccacatctgaagaagttgtgaaccttc atccggggatgctcacacatacttgagccagaattttttcacctatatcctagaatcc aggacccactcaactatcctccatctgttatagagtgactcctctgtcaccatgccc tgacttctctgccattggagtgttatatatggatcatcaataaagccatgaaggc tacacaactgtg |
| 17 | Rat HFE - NM_001173435.1 | tcagcaatggctacagggtgacttcttggatcctccacgtttccaggtcctagtgaa aaccggtggacccagctggaggcatggaccgatcagctgggctccctgtgcggctgc tattgctgctgctgttgttgctgctgtggtccgtggccccgcaggcgctgcggcccg tgcctacttcggtgaaagtgactcgccactgggcctctacagggacctccctaaggt gtcaggctctgaatttcttccccagaacatcactatgaggtggttgaaggacagcc agccctagatgccaaggatgtcaaccctgagaacgtgctgccaaatggggatggga cctatcagggctggctgacccttggctgtggcccctggagaagagacaaggttcagct gtcaagtggagcacccaggcctggatcagcctctcactgccacttgggagccctcac ggtctcaggacatgattattggaatcataagtgggatcaccatttgtgccatcttct ttgttggaattctgatcctagtcttaaggaaaaggaaggtttcaggaggaaccatgg gtgactatgtcttaacagagtgtgagtgacctgcagcatgcagaagcacagaagaga gaagactcagccaaagacttggaggggacacacttgctccattctagaacacagctg gacctaacacacagaaactgcctgaggactctgcccttagctttcctgtttgctttc ttaaggtgttttctccagttaagttcagttcctgaataatagtgactgccccagctg caacctctcccttcagaaccagtctcatgatctttaagctgctacttgcaggcatcc ttcgttttctgcatccacctagacttcgtatgtctacttaaaaagccccactaaatt tggggacacatgattcatttccacatctgaagaagtttatgaaccttcatcctggga tgcacacattcttgtgccagaattttttcatacatatcctaggacccattcaattgtc atttgagcccctctatccgttagtgactactctgacttctctgccattggagtgtta tggcaataaagctatgaacgtta |
| 18 | Mouse BMPR1a - NM_009758.4 | ccgcgcgagacgacgactgtacggccgcgcgaggggcgaccgggccccgggccgctgc acgccgagggcggaggccgagccgggccccgccgccccgcggctgtccgtgcccgcc cgcgccgagcgccggaggatgagtttctcggatcccgatttatgaaaatatgcatc gctttgatactgtctggaattccatgagatggaagcataggtcaaagctgttcggag aaattggaactacagttttatctagccacatctctgagaattctgaagaaagcagca ggtgaaagtcattgccaagtgattttgttctgtaaggaagcctccctcattcactta caccagtgagacagcaggaccagtcattcaaagggccgtgtacaggacgcgtgcgaa tcagacaatgactcagctatacacttacatcagattactgggagcctgtctgttcat catttctcatgttcaagggcagaatctagatagtatgctccatggcactggtatgaa atcagacttggaccagaagaagccagaaaatggagtgactttagcaccagaggatac cttgccttctttaaagtgctattgctcaggacactgcccagatgatgctattaataa cacatgcataactaatggccattgctctgccatcataagaagatgatcagggaga aaccacattaacttctgggtgtatgaagtatgaaggctctgattttcaatgcaagga ttcaccgaaagcccagctacgcaggacaacagaatgtcgtcggaccaatttgtgcaa ccagtatttgcagcctacactgcccctgttgttataggtccgttcttgatggcag catccgatggctggttgtgctcatttccatggctgtctgtatagttgctatgatcat cttctccagctgcttttgctataagcattattgtaagagtatctcaagcaggggtcg ttacaaccgtgatttggaacaggatgaagcatttattccagtaggagaatcattgga agacctgattgaccagtcccaaagctctgggagtggatctggattgcctttattggt tcagcgaactattgccaaacagattcagatggttcggcaggttggtaaaggccgcta tggagaagtatggatgggtaaatggcgtggtgaaaaagtggctgtcaaagtgttttt taccactgaagaagctagctggttttagagaaacagaaatctaccagacggtgttaat gcgtcatgaaaatatacttggttttatagctgcagacattaaaggcactggttcctg gactcagctgtatttgattactgattaccatgaaaatggatctctctatgactccct gaaatgtgccacactagacaccagagcccctactcaagttagcttattctgctgcttg tggtctgtgccacctccacacagaaatttatggtacccaagggaagcctgcaattgc tcatctgagacctgaagagcaaaaacatccttattaagaaaaatggaagttgctgtat tgctgacctgggcctagctgttaaattcaacagtgatacaaatgaagttgacatacc cttgaataccagggtgggcaccaagcgtgtaggttgtccagaagtgctgatgaaag cctgaataaaaaccatttccagccctacatcatggctgacatctatagctttggttt gatcatttgggaaatggctcgtcgtcgtattacaggaggaatcgtggaggaatatca attaccatattacaacatggtgcccagtgacccatcctatgaggacatgcgtgaggt tgtgtgtgtgaaacgcttgcggccaatcgtgtctaaccgctggaacagcgatgaatg tcttcgagcagttttgaagctaatgtcagaatgtggggcccataatccagcctccag |

TABLE B-continued

| SEQ ID NO | DESCRIPTION | SEQUENCE |
|---|---|---|
| | | actcacagctttgagaatcaagaagacacttgcaaaaatggttgaatcccaggatgt aaagatttgacaattaaacaattttgagggagaatttagactgcaagaacttcttca cccaaggaatgggtgggattagcatggaataggatgtcgacttggtttccagactcc ttcctctacatcttcacaggctgctaacagtaaaccttaccgtactctacagaatac aagattggaacttggaacttcaaacatgtcattctttatatatggacagctttgttt taaatgtggggttttttgttttgctttttttgttttgttttggttttgatgctttt ttggttttatgaactgcatcaagactccaatcctgataagaagtctctggtcaacc tctgggtactcactatcctgtccataaagtggtgctttctgtgaaagccttaagaaa attaatgagctcagcagagatggaaaaaggcatatttgccttctaccagagaaaaca tctgtctgtgttctgtctttgtaaacagcctatagattatgatctctttgggatact gcctggtttatgatggtgcaccatacctttgatatgcataccagaattctctgctgc cctagggcttagaagacaagaatgtaaaggttgcacaggaaggtatttgtggccagt ggtttaaatatgcaatatctagttgacaatcgccaatttcataaaagccatccacct tgtaactgtagtaacttctccactgactttatttttagcataatagttgtgaaggcc aaactccatgtaaagtgtccatagacttggactgttttccccagtcaccattttgt tctccttttggtaattattttttgttataaaaagccacctatccagaattggagctct ctgtcttgaaccatactttgaaagaaacgcctcttccgtactgcatctgatcacaat gtgcatacctatgatcaaattctggagtcttgttctcggtacctcctaaaaaggaa agttgattcttgtgcaacatgcttttattttcagaacctgcacagctgtcattctag ccatgttttacctacacactcagttctacacaagacagcccatacactctgtctcac atctgatcctgtggggaagtgttttaaagtagaactatgtatgaatttcagaattc atgcatttaaaacttcactaagatattgtctcatatctttatgagaatgtcagctg actttcaactaacagtaaatgtattttagatatctaaatctttttgaaatttggttt tacaatttctggtccctaattgtgaagacaagaggcagaagtacccagtcactaccc atatttacactgaacgttattaaataaaatgatgtgtattttattataaaataaata taggccttgttatctcaaaaaacagatctggttcaaacttattataccaatatcata ctatttaaatgttctaagtaaacaagccatgtgagcatcaagtggcattggctcttt ggatgaaacataaacttaaggtgattgtatcaacacatagagtgactgaaattaaat gggaggcaggtagagcatatgtccatctgtccacctacaggcatgactaaactacag ctcatattccacaaatttgagatttgtcttgcctggtttgtttagtgagtctcatct gatgtacctaaagcctgagagtactgaggtctgattttatatctttcccgaataaac taaatcttttttgtcacttatcatcttaatgatatacctaaggaataattcttggc atgtttcagttgtgcgtggcagccactgtaatgactcttctctaagaaaggctgtca ggagttaattataaggcaggcagtgagcgctctagtcactgccttcccacgctgcca tcactgcattcatgggaatcagtgacgttctcgaaatggcaaacgctgctgctttc cttatttggaatcctaaaatcaaaagttgcattaaacttactgtgttctcttatccc tctcagccataaatgtaaaattcagtaagtaaaaatatttaaagagtgtatcagccc tttggccagtgagatagctcagtagataaaggcatttgctgccaagtcctcaacctc aattcagactctgggggacacatggcgaagggaggagccaactaccccatcattgtc ctctgacttccacacactccatggcttgcgcccctcccacagacacacaccatgta ctccacaaaagtagtttaaaggaaaaaaagaatagaacccactgtgtaatggaataa gtattatgtagttacttaacaacttgtaaaaatctggaaactacgatttggttcccc tttgaatctagagtttaaaaaacagatggctaaaatcagccatcatttaaataatta aaaataaaagcccaaacccaaactgcctaaatiaaatiaaccaagtaatccaggaagc cgtcatgtgtggtttgtatgaccagtagttctctggtacagagcatgttaagatttg ccccagcctgattctctgaggtctctgcattactgagtactgtcctgagtataaaat ctgaactgatttctctagaaatactgtaacaaaaaggtatttagtcagcatgttat gttaacccttccactgtctagaaacttgaataagcacataaagacacctttgctgt catcatctgttgtcctggaatgtgccagtttttaaattttattcattctaatgatattca atttgcttttcttttttagatgtttttcttgtttagagtaaaaggacgaattttca agaaccttgcatctctgatttggcctaaggtcaaattggatattgagtagtctattc cagggcagatttcctaagcaatacttgtctttttcagctatgtattgtttgaaatgt ttccatttcaacagaggtgtaagtcatgtgaaaagaaaggtggtgtagcccttgtgg taatgacacaagttgacttgcgtcagatgttaagcagggacagttctcccacctcct ggctgtaaggagtggaaactaggcaagcagtgtatcagtccacagaggacaggaagg gtcatcccataaagaaagcctgtgagtatggctttggcaaaaaattagacataatac tgtccttttaggttgtgctctgttctttcctttcagtggaattatttaagctcttta gtggcctttgttttcccacttaaaaactaaaatgtagcatatattgtataaaatgg aaatattaatagcttagggaaactgtacataaggcattgacaggtttaaaaaaagca ttttattatgcagttgtaaaacaccaaaaatatagattcatcttgatatgtaacac taagtgtattttgtacagcatctgatttgaaaggtgccttatgaagtttaccattaa ttgctttgttctatatacagattatgtccaatgtatcattttcagtaaataaccttattttagta |
| 19 | Rat BMPR1a - NM_030849.1 | gaattcatgagatggaaacataggtcaaagctgtttggagaaattggaactacagtt ttatctagccacatctctgagaagtctgaagaaagcagcaggtgaaagtcattgtca agtgattttgttcttctgtaaggaaacctcgttcagtaaggccgtttacttcagtga aacagcaggaccagtaatcaaggtggcccggacaggacacgtgcgaattggacaatg actcagctatacacttacatcagattactgggagcctgtctgttcaccatttctcat gttcaagggcagaatctagatagtatgctccatggtactggtatgaaatcagacgtg gaccagaagaagccggaaaatggagtgacgttagcaccagaggacaccttacctttc ttaaaatgctattgctcaggacactgcccagatgacgctattaataacacatgcata actaatggccattgctttgccattatagaagaagatgatcagggagaaaccacgtta acttctgggtgtatgaagtatgaaggctctgattttcaatgcaaggattcaccaaaa gcccagctacgcaggacaatagaatgttgtcggaccaatttgtgcaaccaatatttg cagcctacactgccccctgtcgttataggccattcttttgatggcagcgtccgatgg |

TABLE B-continued

| SEQ ID NO | DESCRIPTION | SEQUENCE |
|---|---|---|
| | | ctggctgtgctcatctctatggctgtctgtattgtcgccatgatcgtcttctccagc tgcttctgttacaaacattactgtaagagtatctcaagcagaggtcgttacaaccgt gacttggaacaggatgaagcatttattccagtaggagaatcactgaaagacctgatt gaccagtcacaaagctctggtagtggatctggattacctttattggttcagcgaact attgccaaacagattcagatggttcggcaggttggtaaaggccggtatggagaagta tggatgggtaaatggcgtggtgaaaaagtggctgtcaaagtatttttaccactgaa gaagctagctggtttagagaaacagaaatctaccagacggtgttaatgcgtcatgaa aatatacttggttttatagctgcagacattaaaggcaccggttcctggactcagctg tatttgattactgattaccatgagaatgggtctctctatgacttcctgaaatgtgcc accctggacaccagagccctactcaagttagcttattctgctgcctgtggtctgtgc cacctccacacagaaatttatggcacgcaaggcaagcctgcaattgctcatcgagac ctgaagagcaaaaacatccttattaagaaaaatggtagttgctgtattgctgacctg ggcctagctgttaaattcaacagtgacacaaatgaagttgacataccccttgaacacc agggtgggcaccaggcggtacatggctccagaagtgctggacgagagcctgagtaaa aaccatttccagccctacatcatggctgacatctacagctttggttttgatcatttgg gagatggcccgtcgctgtattacaggaggaatcgtggaggaatatcaattaccatat tacaacatggtgcctagtgacccatcttatgaagacatgcgtgaggtcgtgtgtgtg aaacgcttgcggccaatcgtctctaaccgctggaacagtgatgaatgtcttcgagcc gttttgaagctgatgtcagaatgctgggcccataatccagcatccagactcacagct ttgagaatcaagaagacgctcgcaaagatggttgaatcccaggatgtaaagatttga caaacagttttgagaaagaatttagactgcaagaaattcacccgaggaagggtggag ttagcatggactaggatgtcggcttggtttccagactctctcctctacatcttcaca ggctgctaacagtaaactttcaggactctgcagaatgcagggttggagcttcagaca taggacttcagacatgctgttctttgcgtatggacagctttgttttaaatgtgggct tttgatgccttttggttttatgaattgcatcaagactccaatcctgataagaagt ctctggtcaaactctggttactcactatcctgtccataaagtggtgctttctgtgaa agccttaaggaaattagtgagctcagcagagatggagaaaggcatatttgccctcta cagagaaaatatctgtctgtgttctgtctctgtaaacagcctggactatgatctctt tgggatgctgcctggttgatgatggtgcatcatgcctctgatatgcataccagactt cctctgctgccatgggcttacaagacaagaatgtgaaggttgcacaggacggtgttt gtggccagtggttaaatatgcaatatctaatcgacattcgccaatctcataaaagc catctaccttgtaactgaagtaacttctctaccaacttattttttagcataatagtt gtaaaggccaaactatgtataaagtgtccatagactcgaactgttttcctccagtca ccattttgttttccttttggtaattatttttgttatataatccctctatccagaat tggcgctcactgtcttgaaccatactttgaaagaaatgcctcttcctggagtctgcc ttactgcatctgatcaccatgtgcataccctctgatcaaattctggagtctttgttct cggtacctcttaaaaagggaaattgtgtatcatgtgtagtgtgcttttattttcaaa atcttcatagcctttattctagccattttttacctacatactcattctgtacaaaaca gctcactcggtctcacggctgatcctcagtggaaatgatttaaagtagagctgtgta cgaatttcagaattcatgtatttaaaaacttcacactaacactttactaagatattg tctcatatcttttatgaggatgtcagctgattttcaatgactataaatgtatcttag ctatctaaatcttttgaaatttggttttataatttctggtccctaacttgtgaagac aaagaggcagaagtacccagtctaccacatttacactgtacattattaaataaaaaa atgtatattttaaaaaaaaaaaaaaaaaaaaaa |
| 20 | Human SMAD4 - NM_005359.5 | atgctcagtggcttctcgacaagttggcagcaacaacacgccctggtcgtcgtcgc cgctgcggtaacggagcggtttgggtggcggagcctgcgttcgcgccttcccgctct cctcgggaggcccttcctgctctcccctaggctccgcggccgcccaggggtgggag cgggtgaggggagccaggcgcccagcgagagaggcccccgccgcagggcggcccgg gagctcgaggcggtccggcccgcgcgggcagcggcgcggcgctgaggaggggcggcc tggccgggacgcctcgggggcggggccgaggagctctccgggccgccgggaaagct acgggcccggtgcgtccgcggaccagcagcgcgggagagcggactccctcgccacc gcccgagcccaggttatcctgaatacatgtctaacaattttccttgcaacgttagct gttgttttcactgtttcaaaggatcaaaattgcttcagaaattggagacatattt gatttaaaaggaaaaacttgaacaaatggacaatatgtctattacgaatacaccaac aagtaatgatgcctgtctgagcattgtgcatagtttgatgtgccatagacaaggtgg agagagtgaaacatttgcaaaagagcaattgaaagtttggtaaagaagctgaagga gaaaaagatgaattggattcttaataacagctataactacaaatggagctcatcc tagtaaatgtgttaccatacagagaacattggatgggaggcttcaggtggctggtcg gaaaggatttcctcatgtgatctatgcccgtctctggaggtggcctgatcttcacaa aaatgaactaaaacatgttaaatattgtcagtatgcgtttgacttaaaatgtgatag tgtctgtgtgaatccatcactacgaacgagttgtatcacctggaattgatctctc aggattaacactgcagagtaatgctccatcaagtatgatggtgaaggatgaatatgt gcatgactttgagggacagccatcgttgtccactgaaggacattcaattcaaaccat ccagcatccaccaagtaatcgtgcatcgacagagacatacagcacccagctctgtt agcccatctgagtctaatgctaccagcactgccaactttcccaacattcctgtggc ttccacaagtcagcctgccagtatactgggggcagccatagtgaaggactgttgca gatagcatcagggcctcagccaggacagcagcagaatggatttactggtcagccagc tacttaccatcataacagcactaccacctggactggaagtaggactgcaccatacac acctaatttgcctcaccaccaaaacggccatcttcagcaccaccgcctatgccgcc ccatcccggacattactggcctgtttcacaatgagcttgcattcctgcctccccatttc caatcatcctgctcctgagtattggtgttccattgcttactttgaaatggatgttca ggtaggagagacatttaaggttccttcaagctgccctattgttactgttgatggata cgtggaccttctggaggagatcgcttttgtttgggtcaactctccaatgtccacag gacagaagccattgagagagcaaggttgcacataggcaaggtgtgcagttggaatg taaaggtgaaggtgatgtttgggtcaggtgccttagtgaccacgcggtctttgtaca |

TABLE B-continued

| SEQ ID NO | DESCRIPTION | SEQUENCE |
|---|---|---|
| | | gagttactacttagacagagaagctgggcgtgcacctggagatgctgttcataagat ctacccaagtgcatatataaaggtctttgatttgcgtcagtgtcatcgacagatgca gcagcaggcggctactgcacaagctgcagcagctgcccaggcagcagccgtggcagg aaacatccctggcccaggatcagtaggtggaatagctccagctatcagtctgtcagc tgctgctggaattggtgttgatgaccttcgtcgcttatgcatactcaggatgagttt tgtgaaaggctggggaccggattacccaagacagagcatcaaagaaacaccttgctg gattgaaattcacttacaccgggccctccagctcctagacgaagtacttcataccat gccgattgcagacccacaacctttagactgaggtcttttaccgttggggcccttaac cttatcaggatggtggactacaaaatacaatcctgtttataatctgaagatatattt cacttttgttctgctttatcttttcataaagggttgaaaatgtgtttgctgccttgc tcctagcagacagaaactggattaaaacaatttttttttcctcttcagaacttgtc aggcatggctcagagcttgaagattaggagaaacacattcttattaattcttcacct gttatgtatgaaggaatcattccagtgctagaaaatttagcccttttaaaacgtctta gagccttttatctgcagaacatcgatatgtatatcattctacagaataatccagtat tgctgattttaaaggcagagaagttctcaaagttaattcacctatgttattttgtgt acaagttgttattgttgaacatacttcaaaaataatgtgccatgtgggtgagttaat tttaccaagagtaactttactctgtgtttaaaaagtaagttaataatgtattgtaat ctttcatccaaaatatttttttgcaagttatattagtgaagatggtttcaattcagat tgtcttgcaacttcagttttattttttgccaaggcaaaaaactcttaatctgtgtgta tattgagaatcccttaaaattaccagacaaaaaaatttaaaattacgtttgttattc ctagtggatgactgttgatgaagtatacttttcccctgttaaacagtagttgtattc ttctgtatttctaggcacaaggttggttgctaagaagcctataagaggaatttctt tccttcattcataggggaaaggttttgtatttttaaaacactaaaagcagcgtcact ctacctaatgtctcactgttctgcaaaggtggcaatgcttaaactaaataatgaata aactgaatattttggaaactgctaaattctatgttaaatactgtgcagaataatgga aacatcacagttcataataggtagtttggatattttgtacttgatttgatgtgact ttttttggtataatgtttaaatcatgtatgttatgatattgtttaaaattcagtttt tgtatcttggggcaagactgcaaacttttttatatcttttggttattctaagcccct tgccatcaatgatcatatcaattggcagtgacttttgtatagagaatttaagtagaaa agttgcagatgtattgactgtaccacagacacaatatgtatgcttttttacctagctg gtagcataaataaaactgaatctcaacatacaaagttgaattctaggttttgatttt aagattttttttttctttttgcacttttgagtccaatctcagtgatgaggtaccttct actaaatgacaggcaacagccagttctattgggcagctttgttttttccctcacac tctaccgggacttccccatggacattgtgtatcatgtgtagagttggtttttttttt ttttaattttttattttactatagcagaaatagacctgattatctacaagatgataaa tagattgtctacaggataaaatagtatgaaataaaatcaaggattatctttcagatgt gtttacttttgcctggagaacttttagctatagaaacacttgtgtgatgatagtcct ccttatatcacctggaatgaacacagcttctactgccttgctcagaaggtcttttaa atagaccatcctagaaaccactgagtttgcttatttctgtgatttaaacatagatct tgatccaagctacatgacttttgtctttaaataacttatctaccacctcatttgtac tcttgattacttacaaattctttcagtaaacacctaattttcttctgtaaaagtttg gtgatttaagttttattggcagtttttataaaagacatcttctctagaaattgctaa cttaggtccatttttactgtgaatgaggaataggagtgagttttagaataacagatt tttaaaaatccagatgatttgattaaaaccttaatcatacattgacataattcattg cttcttttttttgagatatggagtcttgctgtgctgcccaggcaggagtgcagtggt atgatctcagctcactgcaacctctgcctcccgggttcaactgattctcctgcctca gcctcctggtagctaggattacaggtgcccgccaccatgcctggctaacttttgta gttttagtagagacggggtttgccggttgtgccaggctggtcttgaactcctgacct caagtgatccatccaccttggcctcccaaagtgctgggattacgggcgtgagccact gtccctggcctcattgttccctttttctactttaaggaaagttttcatgtttaatcat ctggggaaagtatgtgaaaaatattgttaagaagtatctctttggagccaagccac ctgtcttggtttctttctactaagagccataaagtatagaaatacttctagttgtta agtgcttatatttgtacctagatttagtcacacgcttttgagaaaacatctcagtatg ttatgatcagctattcctgagagcttggttgttaatctatatttctatttcttagtg gtagtcatctttgatgaataagactaaagattctcacaggtttaaaattttatgtct actttaagggtaaaattatgaggttatggttctgggtgggttttctctagctaattc atatctcaaagagtctcaaaatgttgaatttcagtgcaagctgaatgagagatgagc catgtacacccaccgtaagacctcattccatgtttgtccagtgcctttcagtgcatt atcaaagggaatccttcatggtgttgcctttattttccggggagtagatcgtgggat atagtctatctcatttttaatagtttaccgcccctggtatacaaagataatgacaat aaatcactgccatataaccttgctttttccagaaacatggctgttttgtattgctgt aaccactaaataggttgcctataccattcctcctgtgaacagtgcagatttacaggt tgcatggtctggcttaaggagagccatacttgagacatgtgagtaaactgaactcat attagctgtgctgcatttcagacttaaaatccattttttgtggggcagggtgtggtgt gtaaaggggggtgtttgtaatacaagttgaaggcaaaataaaatgtcctgtctccca gatgatatacatcttattattttttaaagtttattgctaattgtaggaaggtgagttg caggtatctttgactatggtcatctgggggaaggaaaattttacattttactattaat gctccttaagtgtctatggaggttaaagaataaaatggtaaatgtttctgtgcctgg tttgatggtaactggttaatagttactcaccattttatgcagagtcacattagttca caccctttctgagagccttttgggagaagcagttttattctctgagtggaacagagt tcttttttgttgataatttctagttttgctcccttcgttattgccaactttactggcat tttatttaatgatagcagattgggaaaatggcaaatttaggttacggaggtaaatga gtatatgaaagcaattacctctaaagccagttaacaattattttgtaggtggggtac actcagcttaaagtaatgcatttttttttcccgtaaaggcagaatccatccttgttgc agatagctatctaaataatctcatatcctcttttgcaaagactacagagaataggct atgacaatcttgttcaagccttttccattttttttccctgataactaagtaatttcttt |

TABLE B-continued

| SEQ ID NO | DESCRIPTION | SEQUENCE |
|---|---|---|
| | | gaacataccaagaagtatgtaaaaagtccatggccttattcatccacaaagtggcat
cctaggcccagccttatccctagcagttgtcccagtgctgctaggttgcttatcttg
tttatctggaatcactgtggagtgaaattttccacatcatccagaattgccttattt
aagaagtaaaacgttttaattttagccttttttggtggagttatttaatatgtat
atcagaggatatactagatggtaacattttcttctgtgcttggctatctttgtggac
ttcaggggcttctaaaacagacaggactgtgttgcctttactaaatggtctgagaca
gctatggttttgaatttttagtttttttttttttaacccacttcccctcctggtctct
tccctctctgataattaccattcatatgtgagtgttagtgtgcctccttttagcatt
ttcttcttctctttctgattcttcatttctgactgcctaggcaaggaaaccagataa
ccaaacttactagaacgttctttaaaacacaagtacaaactctgggacaggacccaa
gacactttcctgtgaagtgctgaaaaagacccattgtattggcatttgatatcagt
ttgatgtagcttagagtgcttcctgattcttgctgagtttcaggtagttgagataga
gagaagtgagtcatattcatattttccccttagaataatattttgaaaggtttcat
tgcttccacttgaatgctgctcttacaaaaactgggggttacaagggttactaaatta
gcatcagtagccagaggcaataccgttgtctggaggacaccagcaaacaacacacaa
caaagcaaaacaaaccttgggaaactaaggccatttgttttgttttggtgtcccctt
tgaagccctgccttctggccttactcctgtacagatatttttgacctataggtgcct
ttatgagaattgagggtctgacatcctgccccaaggagtagctaaagtaattgctag
tgttttcagggatttaacatcagactggaatgaatgaatgaaacttttgtcctt
tttttctgtttttttttttctaatgtagtaaggactaaggaaaacctttggtgaag
acaatcatttctctctgttgatgtggatacttttcacaccgtttattaaatgcttt
ctcaataggtccagagccagtgttcttgttcaacctgaaagtaatggctctgggttg
ggccagacagttgeactetcctagtttgccctctgccacaaatttgatgtgtgacctt
tgggcaagtcatttatcttctctgggccttagttgcctcatctgtaaaatgagggag
ttggagtagattaattattccagctctgaaattctaagtgacctggctaccttgca
gcagttttggatttcttccttatctttgttctgctgtttgaggggggctttttactta
tttccatgttattcaaaggagactaggcttgatattttattactgttcttttatgga
caaaaggttacatagtatgcccttaagacttaattttaaccaaaggcctagcaccac
cttaggggctgcaataaacacttaacgcgcgtgcgcacgcgcgcgcacacacaca
cacacacacacacacacacaggtcagagtttaaggctttcgagtcatgacattct
agcttttgaattgcgtgcacacacacacgcacgcacacactctggtcagagtttatt
aaggctttcgagtcatgacattatagcttttgagttggtgtgtgtgacaccaccctc
ctaagtggtgtgtgcttgtaatttttttttcagtgaaaatggattgaaaacctgtt
gttaatgcttagtgatattatgctcaaaacaaggaaattcccttgaaccgtgtcaat
taaactggttcatatgactcaagaaaacaataccagtagatgattattaactttatt
cttggctctttttaggtccattttgattaagtgacttttggctggatcattcagagc
tctcttctagcctaccttggatgagtacaattaatgaaattcatattttcaaggac
ctgggagccttccttggggctgggttgagggtgggggttggggagtcctggtagag
gccagctttgtggtagctggagaggaagggatgaaaccagctgctgttgcaaaggct
gcttgtcattgatagaaggactcacgggcttggattgattaagactaaacatggagt
tggcaaactttcttcaagtattgagttctgttcaatgcattggacatgtgatttaag
ggaaaagtgtgaatgcttatagatgatgaaaacctggtgggctgcagagcccagtt
agaagaagtgagttgggggttgggacagatttggtggtggtatttcccaactgttt
cctcccctaaattcagaggaatgcagctatgccagaagccagaagagccactcgt
agcttctgctttggggacaactggtcagttgaaagtcccaggagttcctttgtggct
ttctgtatacttttgcctggttaaagtctgtggctaaaaaatagtcgaacctttctt
gagaactctgtaacaaagtatgtttttgattaaaagagaaagccaactaaaaaaaaa
aaaaaaaaaa |
| 21 | Mouse SMAD4 - NM_008540.2 | ccgctgcggtaacggagcggctcggcggcggagcccgtgttcgcgtccgtccgccc
gcccgcccgccgtcctccggaggcccttcccgcgccgcgctccgctccgcggccgtc
cccggggcgggagcgcgtgaccggagccggcgcccgcgagcgaggcccccgcagcg
gggcggctccggagctccagcggcccggccggccggcgcggtccggcgcggcggg
gagaggggccgcctgggccggacgcgcgggcggggcccgggaagcgacagcgagg
cgaggcgggtcgggcgcggagcccaggtcatcctgctcaccagatgtcttgacagt
ttttcttgcaacattggccattggttttcactgccttcaaaagatcaaaattactcc
agaaatcggagagttggatttaaaagaaaaaacttgaacaaatggacaatatgtcta
taacaaatacaccaacaagtaacgatgcctgtctgagcattgtacatagtttgatgt
gccatagacaaggtgggaaagtgaaacctttgcaaaaagagcaattgagagtttgg
taaagaagctgaaagagaaaaagatgaattggattctttaataacagctataacta
caaatggagctcatcctagcaagtgtgtcaccatacagagaacattggatggacgac
ttcaggtggctggtcggaaaggatttcctcatgtgatctatgcccgtctgtggaggt
ggcctgatctacacaagaatgaactaaagcatgttaaatattgtcagtatgcgtttg
acttaaaatgtgacagttctgtgtgaatccatatcactatgagcgggttgtctcac
ctgaattgatctctcaggattaacactgcagagtaatgctccaagtatgttagtga
aggatgagtacgttcacgactttgaaggacagccgtccttacccactgaaggacatt
cgattcaaaccatccaacacccgccaagtaatcgcgcatcaacggagacgtacagcg
ccccggctctgttagcccggcagagtctaacgccaccagcaccaccaacttcccca
acattcctgtggcttccacaagtcagccggccagtattctggcgggcagccatagtg
aaggactgttgcagatagcttcagggcctcagccaggacagcagcagaatggattta
ctgctcagccagctacttaccatcataacagcactaccacctggcctgaggtagga
ctgcaccatacacacctaatttgcctcaccaccaaaacggccatcttcagcaccacc
cgcctatgccgcccatcctggacattactggcagttcacaatgagcttgcattcc
agcctcccatttccaatcatcctgctcctgagtactggtgctccattgcttactttg
aaatggacgttcaggtaggagagacgtttaaggtcccttcaagctgccctgttgcga
ctgtggatggctatgtggatccttcgggaggagatcgcttttgcttgggtcaactct |

TABLE B-continued

| SEQ ID NO | DESCRIPTION | SEQUENCE |
|---|---|---|
| | | ccaatgtccacaggacagaagcgattgagagagcgaggttgcacataggcaaaggag<br>tgcagttggaatgtaaaggtgaaggtgacgtttgggtcaggtgccttagtgaccacg<br>cggtctttgtacagagttactacctggacagagaagctggccgagcacctggcgacg<br>ctgttcataagatctaccaagcgcgtatataaaggtctttgatctgcggcagtgtc<br>accggcagatgcagcaacaggcggccactgcgcaagctgcagctgctgctcaggcgg<br>cggccgtggcagggaacatccctggccctgggtccgtgggtggaatagctccagcca<br>tcagtctgtctgctgctgctggcatcggtgtggatgacctccggcgattgtgcattc<br>tcaggatgagctttgtgaagggctggggcccagactaccccaggcagagcatcaagg<br>aaccccgtgctggattgagattcaccttcaccgagctctgcagctcttggatgaag<br>tcctgcacaccatgcccattgcggacccacagcctttagactgagatctcacaccac<br>ggacgccctaaccatttccaggatggtggactatgaaatatactcgtgtttataatc<br>tgaagatctattgcattttgttctgctctgtcttttcctaaagggttgagagatgtg<br>tttgctgccttgctcttagcagacagaaactgaattaaaacttcttttctattttag<br>aactttcaggtgtggctcagtgcttgaagatcagaaagatgcagttcttgctgagtc<br>ttccctgctggttctgtatggaggagtcggccagtgctgggcgctcagcccttagt<br>gtgtgcgagcgccttgcatgccgaggagagtcagagctgctgattgtaaggctgaga<br>agttctcacagttaagccacctgcccttagtgggcgagttattaaacgcactgtgc<br>tcacgtggcgctgggccagccagctctaccaagagcaactttactctccttttaaaaa<br>ccttttagcaacctttgattcacaatggttttgcaagttaaacagtgaaggtgaat<br>taaattcatactgtcttgcagacttcagggtttcttcccaagacaaaacactaatc<br>tgtgtgcatattgacaattccttacaattatcagtcaaagaaatgccatttaaaatt<br>acaattttttaatccctaatggatgaccactatcaagatgtatactttgccctgtt<br>aaacagtaaatgaattcttctatatttctaggcacaaggttagttatttaaaaaaaaa<br>aaaaaaaagcctaggggagggattttttcccttaattcctagggagaaggttttgtat<br>aaaacactaaaagcagcgtcactctgcctgctgcttcactgttctgcaaggtggcag<br>tacttcaactgaaataatgaatattttggaaactgctaaattctatgttaaatactg<br>tgcagaataatggaaacagtgcagttggtaacaggtggtttggatattttttgtactt<br>gatttgatgtgtgacttcttttcatatactgttaaaatcatgtatgtttgacattg<br>tttaaaattcagttttgtatcttagggcaagactgcagacttttttataccttttg<br>gttataagccctgtgtttgccatccttgatcacttggcggtgactttgtagagattg<br>aagtggaggagttaagacacattgactgtaccacagacacatgcatactttctac<br>ctagttactagcgtaaataaaactgagtcactataaaaaaaaaaaaaaaaaaaaa |
| 22 | Mouse IL6R - NM_010559.2 | gcagtgcgagctgagtgtggagcccgaggccgagggcgactgctctcgctgccccag<br>tctgccggccgcccggccccggctgcggagccgctctgccgcccgccgtcccgcgta<br>gaaggaagcatgctgaccgtcggctgcacgctgttggtcgccctgctggccgcgccc<br>gcggtcgcgctggtcctcgggagctaccgcgcgctggaggtggcaaatggcacagtg<br>acaagcctgccaggggccaccgttaccctgatttgcccgggaaggaagcagcaggc<br>aatgttaccattcactgggtgtactctggctcacaaaacagagaatggactaccaca<br>ggaaacacactggttctgagggacgtgcagctcagcgacactggggactatttatgc<br>tccctgaatgatcacctggtggggactgtgcccttgctggtggatgttccccagag<br>gagcccaagctctcctgcttccggaagaacccccttgtcaacgccatctgtgagtgg<br>cgtccgagcagcacccctctccaaccacgaaggctgtgctgcttgcaaagaaaatc<br>aacaccaccaacgggaagagtgacttccaggtgccctgtcagtattctcagcagctg<br>aaaagcttctcctgccaggtggagatcctggagggtgacaaagtataccacatagtg<br>tcactgtgcgttgcaaacagtgtgggaagcaagtccagccacaacgaagcgtttcac<br>agcttaaaaatggtgcagccggatccacctgccaaccttgtggtatcagccatacct<br>ggaaggccgcgctggctcaaagtcagctggcagcaccctgagacctgggacccgagt<br>tactacttgctgcagttccagcttcgataccgacctgtatgttcaaaggagttcacg<br>gtgttgctgctcccggtggcccagtaccaatgcgtcatccatgatgccttgcgagga<br>gtgaagcacgtggtccaggtccgtgggaaggaggagcttgacctggccagtggagc<br>gaatggtccccagaggtcacgggcactccttggatagcagagcccaggaccaccccg<br>gcaggaatcctctggaaccccacacaggtctctgttgaagactctgccaaccacgag<br>gatcagtacgaaagttctacagaagcaacgagtgtcctcgcccccagtgcaagaatcc<br>tcgtccatgtccctgcccacattcctggtagctggaggaagcttggcgtttgggttg<br>cttctctgtgtcttcatcatcctgagactcaagcagaaatggaagtcagaggctgag<br>aaggaaagcaagacgacctctcctccacccccaccgtattccttgggcccactgaag<br>ccgaccttccttctggttcctctcctcacccacacagctctgggtctgacaatacc<br>gtaaaccacagctgcctgggtgtcagggacgcacagagccctctatgacaacagcaac<br>agagactacttattccccagacaatcatctggatggtacctggcagctggcagggca<br>ccacgagatcagcacacaagtttctcatgcgggtcccatccacctggggtggggtgg<br>ggcgggcggggctgcagcttcactaacccacaagagctctgcacaggttctgagtag<br>gtgcagctggtgctgcataggctctgaaggaaggaaggggctgtgaggaacacaggc<br>cattgcgaagacagcttgtgatgactgaatagagatgcccgtcagctccacatctga<br>tagtggctcacaagctgcaccctcaggaggcctcagaaaggggctccaaaggctgcc<br>ccagctgcctcgctctgcctcactgcccaagccaccttttagctctcgaactccta<br>aagtccaagcacttttgccattctctttccgaggccactgaggccgggtggaagcttg<br>gttccgatttccttctcaacatctggaaagcagctgggccggtggtggtgactaat<br>atctcagggcctgatggtttacgcgagtgacaatttcccacaagcagtttttaaatg<br>tgaatgatgaccccaggcactgctggctgcggaggcttcatttttcctcttcgatctc<br>aggacttcaggcgaaaagcggagtggaagtagagagcggatgggtgccaccgtcct<br>catggtacttgcgggaggtacagcctggaaaacacgtttcctgtcccctactctcc<br>caggagagggatgatggtaggggggtgcctcttccagggcggagagaactactttacc<br>ccagccttgccattctgatttcaactggactggagctactaggaaagtcgacattc<br>atgcaaaagaaaaacgttaactagcaagaatgcactttcattttggtttttagag<br>aactgttgcctgtttctctcaagagtctggaagaggccgctcactgcacactactgt |

TABLE B-continued

| SEQ ID NO | DESCRIPTION | SEQUENCE |
|---|---|---|
| | | atgaaccctcactgcccaccctggaggaccaagtgcagtaacggtagcccaaacacc aagtcaagtgaaaatcgagggaaaaaaaaaacaaacaagcaacaaaaaaaaaaacc aaaactaaactaaaaaacaaatcaccccccaaaaaaaaacaaaaccaaaaccaaa aaaaacaaaaaaacaaaacaacaacaacaaaaaaaaccaaaccaacccgctgtttc ctataacagaaaagcctttggtttcatttttttattttgatttttttgtcttaaaaag tataaaaatagcctgtccatgctctgcttcagggaatgagcctgtgaacactcccag gcgcaggcaggaagggtgtctgcttcctgctacacctcactgccaccttggccttcc ttgctttacgtttgactgagtggcctcagacgctttccctggggccttgaggaatc cagtgatgttagtggtcaccgaggagaccacagagccacagtgtggtgcttagatta aagtgacttctgcaaccacagcaccccacacctgccgtcttactgaactacgccagt aacttgccttttctgccaccaccacgagacgagacgggcagagctcggaagctgtca ccccatgccctctgcttgtccgctctaggggccactgacctaagcattagttatttt attttattttattttttgtgggttttgtacattttaggtcctgttgctgtcttaga aaaggctctgtaggttgacagaaaatcaggccaagtattcatgttttgtttttttt ttttccttctttcctcctttgctaagtttttgggactcaagggtagcaaaactgct gtgaaagggaaatttattaaaaatgttacagatcgtg |
| 23 | Rat IL6R - NM_017020.3 | gccccacgtagaaggaaccatgctggccgtcggctgcaccctgctggtcgccctgct ggccgcgcccgcagtcgcgctggtccttgggagctgccgcgcgctggaggcggcaaa tggtacggtgacgagcctgccaggggccactgttaccctgatctgccctgggaagga agcagcaggcaatgctaccattcactgggtgtactcaggctcacagagcagagaatg gactaccacgggaaacacactggttctgagggccgtgcaggtcaacgacactgggca ctatttgtgcttcctggatgatcatctggttgggactgtgcccttgctggtggatgt tcccccagaggagcccaagctctcctgcttccggaagaaccccttgtaaatgcctt ttgtgagtggcatccaagcagcactccctctccaaccacgaaggctgtgatgtttgc aaagaaaatcaacaccaccaatgggaagagtgacttccaggtgccttgccagtattc tcagcagctgaaaagcttctcctgcgaggtggagatcctggagggtgacaaagtgta ccacatagtgtcactgtgcgttgcaaacagtgtcggaagcaggtccagccacaatgt agtatttcagagtttaaaaatggtgcagccggatccacctgccaaccttgtggtatc agccatacctggaaggcctcgttggctcaaagtcagttggcaagaccctgagtcctg ggacccaagttactacttgttgcaattcgagcttcgataccgacctgtatggtcaaa gacgttcacggtgtggccgctccaggtggcccagcatcaatgtgtcatccatgatgc cttgcgaggagtaaagcatgtggtgcaggtccgagggaaggaggagtttgacattgg ccagtggagcaaatggcccccggaggtcacaggcactccttggctagcagagcccag gaccactccggcagggatcccggggaaccccacacaggtctctgttgaagactatga caaccacgaggatcagtacggaagttctacagaagcaacgagtgtcctcgcccagt gcaaggatcctcgcctatacccctgcccacattcctggtagctggaggaagcctggc gtttggattgcttctctgtgtcttcatcatcttgagactcaagaagaaatggaagtc acaggctgagaaggaaagcaagacgacttctcccccaccgtatcccttgggaccgct gaagccgaccttcctcctggttcctctccctaccccatcagggtcccataacagctc tgggactgacaacaccggaagccacagctgcctgggtgtcagggacccacagtgccc taatgacaacagcaacagagactacttattcccagataattgtctggagggtacct ggcagctggcacgcaagtttctcactgccggccccgtccaccagggctgggggcggg gtgggcggggctgcagcttcacgatcccacaggagccttgcaaaggttctgagtggg agaagactggtgtgctgcacgggcttcgaaagaaggggctgtgaggagcacgagcca tcatgaagagagcccgtgatgactctgaatagagacgcccgcccatcagctacacac ctgatggtggctctcaagctatcctctcaggaagcctctgggagggcgacaaaggc tgccccagttgcctagctctggctcactggcccaagctgccttttagcttgaactcc taaaatccaagcacctggccattctcttcctaggccaccgaggccgcggggaagct tggttctactttccttctcaacacctggagaagcagctgcccggtggtggtgactaa cgtatcagggcctgatggcttatgaggaatgacaattaattcctcataagcagtttt taaatgtgaatagtaatcctaggcactgctgacttgaggttttattttcttcaatct caggacttcaggagagaagcagagcagaagtagagagaggatgggtgtccattgtcc gtgtggtacttgagggggatacagcctggaaaacacgtttcctgccccctactctc ccagaagaggtagggggtggcgcctcttccagggcagagagtataactactttacct ggccttgcccatactggtttcaactggacttgagctactaggaaaaatgacattcat gcaaaaagaaaactttaactagcaagaatgcacttccactttggttttctagaggact gttgctcctcttgagacgctggaagaggccgctcactgtaccctggtgtatgagccc tcacccccccacccccagggtaagtgcagtaactttagtctaaacaccgagtcaggtaa aaatcgaggaaaaaacaacccgtttcctgtaacagaaaagcctttggtttcgtttt gtattttgatttttttttgtcttaaaaagtgtaaaaatagtctgtccatactctgc ttcagggaatgacctgtgaatactcccaggcgtgggcaggaagggtgtctgcttcc tgctacacctcactgccacctcggccttcctgcttacattcaactgagttgcctc agctgcttccctggggcgctgaaaaagccagtgatgttggtggtcaccgagaaga ccacagagccacagagtaatgctgtgattgaagcgagctacgcaaccacagcacccc acatttgctgtattatagaactatgctaggagcttgcccttcacaaaataccacca ccacgagacgtggcagagctcggaagctgtccaccttgtgccatctgcttgccagctc caaggggccactgacttaagcagttattttcttgtgggctttgttcatttcagggc ctgttgctgtcttagaaaaagctctgtcggttgacaaaaacatcagacaggtagtca tgtttatttattttttttcctcttttgctaagtcttgggactcaagggtagtaaaa aatgctgtgaaaagggaaacattagaaacagcgatcttcgggagataggtgactgtg cccacgcactgttcttcagtccctcacgtggctctgcccgagcgctgttccaagca ggcagagcaggctggcggaagattgaaatccagatagttcgttatctctgagagcta aatagctttgatctccaagctgttattgcttcactattgtaacaggatagcctccc ccccccatgtcaaaaggatgcttttcctttgactttttataagctaagtcagtga agtctgtttcatctgagctccagcttcgttcagttcgcacaggtgtatgccctcagc |

TABLE B-continued

| SEQ ID NO | DESCRIPTION | SEQUENCE |
|---|---|---|
| | | tgcttcgggcctcagatctgtgctagttgaatggttgtcccatccttgggtcatcct taccagagtttctgcagcccacaggtctgccttgtcaacagtaccacttaacaccag cattcagtgcccaggcagccagatgtggagggtttacccagagatgatttaaacatg accttaaacgtgtatggtagaacgaggggaacccataccagctcaggttctaaagag atctttgattcttctggcattagtgaaatagctttaaactatttcaaggaagaagcc ttggccacacccacgacatttggtgacaatccttctctcccatgagccttgtctttg caccttctcacctggctgaaagctcacactgaatctttcctatgcccctggtgtctt gggagaaaggaaactggtatgggcttcactgctggaattggcttggagccagcgtgt ggcgcagcgcctggcagggtgggccaggcttagttatggtgtgctggtttaaggaat gcctggcttgcctggttgcttgggttctgagctgcagagtttcctagcagttcttta tggctgacctagttggggaagattcccacactcaactgcaggtggaggtggtgagaa agctgttttcattcggagaggcaggatcagcccaagaagctttcagtgggagagcct acagtgaggcgtacctcactgtgggaggaggcaggccagctggctcaggtcctggg actggcactgggaggtctgccaaaggtccctccagcctgtagtcctagcatagtc gggtgccagttccaggaagtttctacggcaaccttagtgctcattaaggaacattgt cagttttgtgaacatatgctcagatggagatcttgctttcagagaaaggactggtac agtgtgtaacaagctggagcagacagagagacttttggcaagagatcacatccgtt aagcagaatacctcagtgctacatgttttttgtctttgagacaatgttttttaaggttt ttatgctctgttacctgtaagctgatacctaaaactttctgcaaagtcagggttttt caatgcctttttttttttttgccattgtttgctttaaagtgaagattgtaactgtt tgaaataaataatttctaaaactgca |
| 24 | Human BMP6 - NM_001718.4 | caactgggggcgcccggacgaccatgagagataaggactgagggccaggaagggga agcgagcccgccgagaggtggcggggactgctcacgccaagggccacagcggccgcg ctccggcctcgctccgccgctccacgcctcgcgggatccgcgggggcagcccggccg ggcgggatgccggggctgggcggagggcgcagtggctgtgctggtggcggggct gctgtgcagccgctgcgggccccgcgctgcggccgcccttgcccgctgccgcggc cgccgccgccgggggcagctgctggggacggcgggagccccggccgcacggagca gccgccgcgtcgccgcagtcctcctcgggcttcctgtaccggggctcaagacgca ggagaagcgggagatgcagaaggagatcttgtcggtgctggggctcccgccacggcc ccggccctgcacggcctccaacagccgcagccccggcgctccggcagcaggagga gcagcagcagcagcagctgcctcgcggagagcccctcccgggcgactgaagtc cgcgcccttcttcatgctggatctgtacaacgccctgtccgccgacaacgacgagga cggggcgtcggaggggagaggcagcagtcctggccccacgaagcagccagctcgtc ccagcgtcggcagccgcccccgggcgccgcgcacccgctcaaccgcaagagccttct ggccccgatctggcagcggcggcgcgtcccactgaccagccgcgcaggacagcgc cttcctcaacgacgcggacatggtcatgagctttgtgaacctggtggagtacgacaa ggagttctcccctcgtcagcgacaccacaaagagttcaagttcaacttatcccgat tcctgagggtgaggtggtgacggctgcagaattccgcatctacaaggactgtgttat ggggagttttaaaaaccaaactttttcttatcagcatttatcaagtcttacaggagca tcagcacagagactctgacctgtttttgttggacacccgtagtatgggcctcaga agaaggctggctgaaatttgacatcacggccactagcaatctgtgggttgtgactcc acagcataacatggggcttcagctgagcgtggtgacaagggatggagtccacgtcca ccccccgagccgcaggcctggtggggcagagacggcccttacgacaagcagccttcat ggtggctttcttcaaagtgagtgaggtgcacgtgcgcaccaccaggtcagcctccag ccggcgccgacaacagagtcgtaatcgctctacccagtcccaggacgtggcgcgggt ctccagtgcttcagattacaacagcagtgaattgaaaacagcctgcaggaagcatga gctgtatgtgagtttccaagacctgggatggcaggactggatcattgcacccaaggg ctatgctgccaattactgtgatggagaatgctccttcccactcaacgcacacatgaa tgcaaccaaccacgcgattgtgcagacccttggttcaccttatgaacccgagtatgt ccccaaaccgtgctgtgcgccaactaagctaaatgccatctcggttctttacttttga tgacaactccaatgtcattctgaaaaaatacaggaatatggttgtaagagcttgtgg atgccactaactcgaaaccagatgctggggacacacattctgccttggattcctaga ttacatctgccttaaaaaaacacggaagcacagtggaggtgggacgatgagacttt gaaactatctcatgccagtgccttattacccaggaagattttaaaggacctcattaa taatttgctcacttggtaaatgacgtgagtagttgttggtctgtagcaagctgagtt tggatgtctgtagcataaggtctggtaactgcagaaacataaccgtgaagctcttcc taccctcctcccccaaaaacccaccaaaattagttttagctgtagatcaagctattt ggggtgtttgttagtaaatagggaaaataatctcaaaggagttaaatgtattcttgg ctaaaggatcagctggttcagtactgtctatcaaaggtagattttacagagaacaga aatcggggaagtgggggaacgcctctgttcagttcattcccagaagtccacaggac gcacagcccaggccacagccagggctccacggggcgcccttgtctcagtcattgctg ttgtatgttcgtgctggagttttgttggtgtgaaaatacacttatttcagccaaaac ataccatttctacacctcaatcctccatttgctgtactctttgctagtaccaaaagt agactgattacactgaggtgaggctacaagggggtgtgtaaccgtgtaacacgtgaag gcaatgctcacctcttctttaccagaacggttctttgaccagcacattaacttctgg actgccggctctagtaccttttcagtaaagtggttctctgccttttttactatacagc ataccacgccacagggttagaaccaacgaagaaaataaaatgagggtgcccagctta taagaatggtgttaggggggatgagcatgctgtttatgaacggaaatcatgatttccc ttgtagaaagtgaggctcagattaaattttagaatatttttctaaatgtctttttcac aatcatgtactgggaaggcaatttcatactaaactgattaaataatacatttataat ctacaactgtttgcacttacagctttttttgtaaatataaactataatttattgtct attttatatctgttttgctgtaacattgaaggaaagaccagacttttaaaaaaaaag agtttatttagaaagtatcatagtgtaaacaaacaaattgtaccactttgattttct tggaatacaagactcgtgatgcaaagctgaagttgtgtgtacaagactcttgacagt tgcgcttctctaggaggttgggttttttaaaaaaagaattatctgtgaaccatacg |

TABLE B-continued

| SEQ ID NO | DESCRIPTION | SEQUENCE |
|---|---|---|
| | | tgattaataaagatttcctttaaggca |
| 25 | Rhesus BMP6 - XM_001085364 | agcgcagcccggactcggacgcacctggcctgtaccgcgcgcctctagagacctgcg cggggctgtggggctcccttcctcccctccaagcggttctcccggtgatcgcccct tcgccacccctctatcctgggcaactgggggcccccggacgaccatgagagataag gactgagggccaggaaggggaagcgagcccgccgagaggtggcgggggctgctcacg ccaagggcacagcggccgtgctccagcctcgctccgccgctccacgcctcgcggga tccgcggggcagcccggccgggcgggatgccggggctggggcggagggcgcagtg gctgtgctggtggtggggctgttgtgcagctgctgcgggccccgccgctgcggcc gcccctgcccgctgccgcggccgccgccgcggggccagctgctggggacggcgg gagccccggccgcacggagcagccgccgcgtcgccgcaatcctccccgggcttcct ctaccggcggctcaagacgcacgagaagcgggagatgcagaaggagatcttgtcggt gctggggctcccacaccggcccggcccctgcacggcctccaacagccgcagccccc ggcgctcccgcagcagcagcagcagcagcagccgcctcgcggagagcccctcc cgggcagctgaagcccgcgccctcttcatgctggatctgtacaacgccctgtccgc cgacgacgaggaggacggggcgtcggaggggagaggcagcagccctggccccacga aggagccagctcgtcccagcctcggcagccgcccgggcgcgcgcacccgctcaa ccgcaagagcctcctggcccccggacctggcagcggcggcgtccccactgaccag cgcgcaggacagcgccttcctcaacgacgcagacatggtcatgagctttgtgaacct ggtggagtacgacaaggagttctcccctcgtcagcgacaccacaaagagttcaagtt caacttatcccagattcctgagggtgaggcggtgacggctgcagaattccgcatcta caaggactgtgttgtggggagttttaaaaaccaaacttttcttatcagcatttatca agtcttacaggagcatcagcacagagactctgaccttttttgctggacacccgcgt agtgtgggcctcagaagaaggctggctggaatttgacatcacgccactagcaatct gtgggccgtgaccccgcagcataacatggggcttcagctgagtgtggtgacgcggga tggagtccacatccatccccgagccgcgggcctggtgggcagagacggcccttacga caagcagcccttcatggtggctttcttcaaagtgagtgaggtccacgtgcgcaccac caggtcagcctctggctggcgccgacaacagagtcgtaatcgctctacccagtccca ggacgtggcgcgggtctccagtgcttcagattacaacagcagtgaattaaaaacagc ttgcaggaagcatgagctgtatgtgagtttccaagacctggatggcaggactggat cattgcacccaagggctacgctgccaattactgtgatggggaatgctccttcccact caacgcacacatgaatgcaaccaaccacgcgatcgtgcagaccttggttcaccttat gaaccctgagtatgtccccaaaccgtgctgtgcgccaactaaactaaatgccatctc agttctttacttttgatgacaattccaatgtcattctgaaaaaatacaggaatatggt tgtaagagcttgtggatgccactaactcgaaaccagatgctggggacacacattctg ccttggattcctagattacatctgccttaaaaaacacagaagcacagttggaggtgg gacgatgagacttggaaactatctcatgccagtgccttattacccaagaagattta aaggacctcattaataatttgctcacttggtaaatgacgtgagtagttgttggtctg tagcaagctgagtttggatgtctgtagtgcaaggtccggtaactgcagaaaagcaccg tgaagctcttcctcccctcctcccccaaaaacccaccaaaattagttttagctgtag atcaagctatttgggtgttagtaagtagggaaaataatctcaaaggagttaaatgt attcttggttaaagtatcagcctgttcagtactgtctatcaaaggtagattttacag agaacagaaattggggaagttgggggaacgcctctgttcagatttcattcccaggaa gttcaacttcatacatgacccacagcccaggccacagccagggctccatggggcgcc tttgtctcagtcattgctgttatgtgttcatgctggagttttgttg |
| 26 | Mouse BMP6 - NM_007556.2 | gatcctggccgtcgccccgtcgtctcttctccaccgggcttctggggcgccgcgg atgaccatgagagataaggactgagtgccaggaccgggaagagagcccgccgagagg tggcgggggctgcccactccgagggcacagcctccgcgctccggcctcgctccgcc gctcgacgcctcgcggccccgcggggcagccgggctgggcggcgatgcccgggct ggggcggagggcgcagtggctggctgtgctggtggtgggggttgctgtgcagctgcggccc cccgccactgcggcccctctgccggtagccgcggccgccgccgggggcagctgct gggagccggcgggagcccggtgcgcgctgagcagccaccgccacagtcctcttcttc gggcttcctctatcggcggctcaagacccacgagaagcgggagatgcaaaaggagat cctgtcggtgctggggctcccgcacaggccgcggcccctgcacggtctccagcagcc tcagccccggtactcccgccacagcagcagcagcagcagcagcagcagacggc ccgcgaggagcccctccagggcggctgaagtccgctccactcttcatgctggatct ctacaacgccctgtccaatgacgacgaagaggatggggcatcggagggtgtgggca agagcctgggtcccacgaggggccagctcgtcccagctcaggcagccgtctcccgg cgctgcacactccttgaaccgcaagagtctcctggcccccgggaccggtggcggtgc gtccccactgactagcgcgcaggacagcgcttcctcaacgacgcggacatggtcat gagctttgtgaacctggtggagtacgacaaggagttctcccacatcaacgacacca caaagagttcaagttcaacctatcccagattcctgagggtgaggcggtgacggctgc tgagttccgcgtctacaaggactgtgtggtggggagttttaaaaaccaaacctttct tatcagcatttaccaagtcttgcaggagcatcagcacagagactctgaccttatttt gttggacacccgggtggtgtgggcctcagaagaaggttggctggaatttgacatcac agcaactagcaatctgtgggtggtgacaccgcagcacaacatggggctccagctgag tgtggtgactcgggatggactccacgtcaaccccgtgcggcgggcctggtgggcag agacggccctacgacaagcagcccttcatggtggcttcttcaaggtgagcgaggt ccacgtgcgcaccaccaggtcagcctccagtcggcggcggcagcagagtcgcaaccg gtccacccagtcgcaggacgtgtcccggggctcggttcttcagactacaacgcag tgagttaaaaacagcttgcaagaagcatgagctgctatgtgagcttccaggacctggg atgcaggactggatcattgcacccaagggctacgctgccaactactgtgatggaga gtgttccttcccactcaacgcacacatgaatgccaccaaccacgccattgtacagac cttggtccaccttatgaatccgagtacgtccccaaaccatgctgcgcaccaaccaa actgaatgccatctcggttctttacttcgatgataactccaatgtcatcttgaaaaa |

| SEQ ID NO | DESCRIPTION | SEQUENCE |
|---|---|---|
| | | gtacaggaatatggtcgtgagagcttgtggttgccattaagttgaagctggtgtgtg<br>tgtgtgggtggggcatggttctgccttggattcctaacaacaacatctgccttaaa<br>ccacgaacaacagcacagcgaagcgggatggtgacacacagagggatcgtgacacgc<br>agacacatctcccgctggtgccttacccacggaggcttttatgaggaccttgtcaag<br>ggctttcccagttcctaactgagcagttgctggtctgcaggaagctggaaggcttgt<br>agtacaggcctggaaactgcagttacctaatgttcgcctcccccaaccccgcccgga<br>gtagttttagcttttagatctagctgcttgtggtgtaagtagagagtaaacttgaag<br>gaatattaaatatccctgggttgaaagacccggtggtggctctacagcaeccatccc<br>agggagattttttgcagacatccgaatggaggggagaagggcactctttcaggttcca<br>ttcccagcaagggcagctcacacaggacctgcagcctggccatcagcaggctctgtg<br>gaggtgccttctgtctactgttgtagttacgtgttttgtgttgactctcggtggtgt<br>gagaatgtactaatctctgtcaagacaaactgtagcattttcaccccatcctcctcc<br>ctccctcacagaattc |
| 27 | Rat BMP6 -<br>NM_013107.1 | atgcccgggctggggcggagggcgcagtggctgtgctggtggtggggggtcactgtgc<br>agctgcggccccccgccactgcggcccctctgccggtagccgcggccgccgccggg<br>gggcagctgctggagccggcgggagccctgtgcgcgccgagcagccaccgccgcaa<br>tcctcctcttcgggcttcctctatcggcggctcaagacccacgagaagcgggagatg<br>caaaaggagatcctgtcggtgttggggctgcctcacaggccgcggcccctgcacggt<br>ctccagcagcctcaatcccccgtgctcccgcagcagcaacaatcgcaacagacggcc<br>cgcgaggagcccctccagggcggctgaagtccgctccgctcttcatgctggatctc<br>tacaactccctgtccaaggacgacgaagaggatggggtgtcagaggagagggactg<br>gagcccgagtcccacggaagggccagctcgtcccagctcaaacagccatctcccggg<br>gctgcacactccctgaaccgcaagagtctcctggccccgggaccccggcggcagtgcg<br>tccccactgaccagccgcgcaggacagcgcttcctcaacgacgcggacatggtcatg<br>agctttgtgaacctggtggagtacgacaaggagttctcccacgccagcgacaccac<br>aaggagttcaagttcaacttatcccagattcccgagggtgaggcagtgacggctgca<br>gagttccgcgtctacaaggactgtgtggtggggagttttaaaaaccaaacttttctt<br>atcagcatttaccaagtcttacaggagcatcagcacagagactctgacctattttg<br>ttggacacccgggtggtgtgggcctccgaagaaggctggctggaattcgacatcaca<br>gcaactagcaatctgtgggtggtgacaccgcagcacaacatgggactccagctgagt<br>gtggtgactcgggacggactccacatcaaccccgtgcggcgggcctggtgggcaga<br>gacggcccttacgacaagcagcccttcatggtggccttcttcaaggcgagcgaggtc<br>cacgtgcgcaccaccaggtcagcctccagtcggcgtcgacagcagagtcgcaatcgg<br>tccacccagtcgcaggacgtgtcccggggctccagtgcttcagactacaacagcagt<br>gagttaaaaacagcttgcaagaagcatgagctttacgtgagcttccaggacctggga<br>tggcaggactggatcatcgcacccaaaggctacgctgccaactattgtgacggagag<br>tgttccttccctctcaatgcacacatgaatgccaccaaccacgccattgtacagacc<br>ttggtccacctttatgaatcccgagtacgtccccaaaccatgctgcgcaccaaccaaa<br>ctgaatgccatctcggttctttacttcgacgacaactccaatgtcatcttgaaaaaa<br>tacaggaacatggttgtgagagcttgtggatgtcattga |
| 28 | Human NEO1 -<br>NM_002499.2 | gggccgggccgggctgggctggagcagcggcggccgcgggagccgagcttgcagcga<br>gggaccggctgaggcgcgcgggagggaaggaggcaagggctccgcggcgctgtcgcc<br>gccgctgccgctcactctcggggaagagatggcggcggagcggggagcccggcgact<br>cctcagcaccccctccttctggctctactgctgctgctgctcgggcgccgggccg<br>gggcgccgcggccgccaggagcggctccgcgccgcagtccccaggagccagcattcg<br>aacgttcactccatttttattttctggtggagccggtggatacactctcagttagagg<br>ctcttctgttatattaaactgttcagcatattctgagccttctccaaaaattgaatg<br>gaaaaaagatggaactttttttaaacttagtatcagatgatcgacgccagcttctcc<br>ggatggatctttatttatcagcaatgtggtgcattccaaacacaataaacctgatga<br>aggttattatcagtgtgtggccactgttgagagtcttggaactattatcagtagaac<br>agcgaagctcatagtagcaggtcttccaagatttaccagccaaccataaccttcctc<br>agtttatgctgggaacaatgcaattctgaattgcgaagttaatgcagatttggtccc<br>atttgtgaggtgggaacagaacagacaaccccttcttctggatgatagagttatcaa<br>acttccaagtggaatgctggttatcagcaatgcaactgaaggagatggcgggcttta<br>tcgctgcgtagtgaaagtggtgggccaccaaagtatagtgatgaagttgaattgaa<br>ggttcttccagatcctgaggtgatatcagacttggtattttgaaacagccttctcc<br>cttagtcagagtcattggtcaggatgtagtgttgccatgtgttgcttcaggacttcc<br>tactccaaccattaaatggatgaaaaatgaggaggcacttgacacagaaagctctga<br>aagattggtattgctggcaggcggtagcctggagatcagtgatgttactgaggatga<br>tgctgggacttattttgtatagctgataatggaaatgagacaattgaagctcaagc<br>agagcttacagtgcaagctcaacctgaattcctgaagcagcctactaatatatatgc<br>tcacgaatctatggatattgtatttgaatgtgaagtgactggaaaaccaactccaac<br>tgtgaagtgggtcaaaaatggggatatggttatcccaagtgattattttaagattgt<br>aaaggaacataatcttcaagttttgggtctggtgaaaccagatgaagggttctatca<br>gtgcattgctgaaaatgatgttggaaatgcacaagctggagcccaactgataatcct<br>tgaacatgcaccagccacaacgggaccactgccttcagctcctcgggatgtcgtggc<br>ctccctggtctctacccgcttcatcaaattgacgtggcggacacctgcatcagatcc<br>tcacggagacaaccttacctactctgtgttctacaccaaggaagggattgctaggga<br>acgtgttgagaataccagtcacccaggagagatgcaagtaaccattcaaaaacctaat<br>gccagcgaccgtgtacatctttagagttatggctcaaaataagcatggctcaggaga<br>gagttcagctccactgcgagtagaaaacacaacctgaggttcagctccctggcccagc<br>acctaaccttcgtgcatatgcagcttcgcctacctccatcactgttacgtgggaaac<br>accagtgtctggcaatggggaaattcagaattataaattgtactacatggaaagggg<br>gactgacaaagaacaggatgttgatgtttcaagtcaccccttacaccattaatgggtt |

TABLE B-continued

| SEQ ID NO | DESCRIPTION | SEQUENCE |
|---|---|---|
| | | gaaaaaatatacagagtatagtttccgagtggtggcctacaataaacatggtcctgg |
| | | agtttccacaccagatgttgctgttcgaacattgtcagatgctcccagtgctgctcc |
| | | tcagaatctgtccttggaagtgagaaattcaaagagtattatgattcactggcagcc |
| | | acctgctccagccacacaaaatgggcagattactggctacaagattcgctaccgaaa |
| | | ggcctcccgaaagagtgatgtcactgagaccttggtaagcgggacacagctgtctca |
| | | gctgattgaaggtcttgatcgggggactgagtataaatttccgagtggctgctctaac |
| | | aatcaatggtacaggcccggcaactgactggctgtctgctgaaacttttgaaagtga |
| | | cctagatgaaactcgtgttcctgaagtgcctagctctcttcacgtacgcccgctcgt |
| | | tactagcatcgtagtgagctggactcctccagagaatcagaacattgtggtcagagg |
| | | ttacgccattggttatggcattggcagccctcatgcccagaccatcaaagtggacta |
| | | taaacagcgctattacaccattgaaaatctggatcccagctctcactatgtgattac |
| | | cctgaaagcatttaataacgtgggtgaaggcatcccctgtatgagagtgctgtgac |
| | | caggcctcacacagacacttctgaagttgatttatttgttattaatgctccatacac |
| | | tccagtgccagatcccactcccatgatgccaccagtgggagttcaggcttccattct |
| | | gagtcatgacaccatcaggattacgtgggcagacaactcgctgcccaagcaccagaa |
| | | gattacagactcccgatactacaccgtccgatggaaaaccaacatcccagcaaacac |
| | | caagtacaagaatgcaaatgcaaccactttgagttatttggtgactggtttaaagcc |
| | | gaatacactctatgaattctctgtgatggtgaccaaaggtcgaagatcaagtacatg |
| | | gagtatgacagcccatgggaccacctttgaattagttccgacttctccacccaagga |
| | | tgtgactgttgtgagtaaagaggggaaacctaagaccataattgtgaattggcagcc |
| | | tccctccgaagccaatggcaaaattacaggttacatcatatattacagtacagatgt |
| | | gaatgcagagatacatgactgggttattgagcctgttgtgggaaacagactgactca |
| | | ccagatacaagagttaactcttgacacaccatactacttcaaaatccaggcacggaa |
| | | ctcaaagggcatgggacccatgtctgaagctgtccaattcagaacacctaaagcgga |
| | | ctcctctgataaaatgcctaatgatcaagcctcagggtctggagggaaaggaagccg |
| | | gctgccagacctaggatccgactacaaacctccaatgagcggcagtaacagccctca |
| | | tgggagccccacctctcctctggacagtaatatgctgctggtcataattgtttctgt |
| | | tggcgtcatcaccatcgtggtggttgtgattatcgctgtcttttgtacccgtcgtac |
| | | cacctctcaccagaaaaagaaacgagctgcctgcaaatcagtgaatggctctcataa |
| | | gtacaaagggaattccaaagatgtgaaacctccagatctctggatccatcatgagag |
| | | actggagctgaaacccattgataagtctccagacccaaaccccatcatgactgatac |
| | | tccaattcctcgcaactctcaagatatcacaccagttgacaactccatggacagcaa |
| | | tatccatcaaaggcgaaattcatacagagggcatgagtcagaggacagcatgtctac |
| | | actggctggaaggcgaggaatgagaccaaaaatgatgatgcccttgactcccagcc |
| | | accccagcctgtgattagtgccatcccatccattccctcgacaaccctcaccatca |
| | | tttccactccagcagcctcgcttctccagctcgcagtcatctctaccacccgggcag |
| | | cccatggcccattggcacacccatgccccttcagacagggccaattccacagaatc |
| | | cgttcgaaataccccccagcactgcaaccatgccagcctcttcgtctcaaaacatgctg |
| | | cactgatcaccaggaccctgaaggtgctaccagctcctcttacttggccagctccca |
| | | agaggaagactcaggccagagtcttcccactgcccatgttcgcccttcccacccatt |
| | | gaagagcttcgccgtgccagcaatcccgcctccaggacctcccacctatgatcctgc |
| | | attgccaagcacaccattactgtcccagcaagctctgaaccatcacattcactcagt |
| | | gaagacagcctccaccgggactctaggaaggagccggcctcctatgccagtggttgt |
| | | tcccagtgcccctgaagtgcaggagaccacaaggatgttggaagactccgagagtag |
| | | ctatgaaccagatgagctgaccaaagagatggcccacctggaaggactaatgaagga |
| | | cctaaacgctatcacaacagcatgacgaccttcaccaggacctgacttcaaacctga |
| | | gtctggaagtcttggaacttaccccttgaaaacaaggaattgtacagagtacgagagg |
| | | acagcacttgagaacacagaatgagccagcagactggccagcgcctctgtgtagggc |
| | | tggctccaggcatggccacctgccttcccctggtcagcctggaagaagcctgtgtcg |
| | | aggcagcttccctttgcctgctgatattctgcaggactgggcaccatgggccaaaat |
| | | tttgtgtccagggaagaggcgagaagtgcaacctgcatttcactttgtggtcaggcc |
| | | gtgtctttgtgctgtgactgcatcacctttatggagtgtagacattggcatttatgt |
| | | acaattttatttgtgtcttattttatttttaccttcaaaaacaaaaacgccatccaaa |
| | | accaaggaagtccttggtgttctccacaagtggttgacatttgactgctcgttccaa |
| | | ttatgtatggaaagtctttgacagcgtgggtcgttcctggggttggcttgtttttg |
| | | gtttcatttttattttttaattctgagtcattgcatcctctaccagctgttaatcca |
| | | tcactctgaggggaggaaatgttgcattgctgtttgtaagcttttttttatttttt |
| | | tttattataattattaaaggcctgactctttcctctcatcactgtgagattacagat |
| | | ctatttgaattgaatgaaatgtaacattgaaaagacttgtttgttgctttctgtgca |
| | | gtttcagtattggggcgggtgggggggctgggggttggtaataggaaatggagggggct |
| | | gctgaggtcctgtgaatgtttctgtcattgtactttcttccagaagcctgcagagaa |
| | | tggaagcatcttctttattgtcctttcctggcatgtccatccttattgtcactacgt |
| | | tgcaactggagtttgatttggatctggttttaaaattcttctgtgcaatagatgggt |
| | | ttgaggatttagcggccctgatgtcttggtcatagcctggtaagaatgtccatgctg |
| | | aggagccagatgttgtatttctaactgcctgagtcacacagaatagggtaagagcct |
| | | gacccccattctgtaaatcagaaagcaaggatggagacccttcctgctgctattatt |
| | | ggctctctttgaggaagttggaggttaaggaaggaacttgtttgtttccgtatacga |
| | | ctccttcttctctctagttcagtcttcagccagtccagcgctctcttccacacttca |
| | | gagccccttcagagaaagcattagcaggaatgagacaaggcagagctgcagtgcccc |
| | | ctgaggcttccacacatctttctgaatattattttttcaagtaacaagggcagggaca |
| | | gcggaaacagctgcccacccccccatcccagcagctcagctaagccctgatgagaa |
| | | tgaagccacaggagttgtctgaggtgaacccagccgctcagccacacatggaagcca |
| | | ttgcctttgcacatagttcttgggttcttttttcctaaaaaggtaaggagctgaggtg |
| | | tgtggtttttaatattaagaatatataatggaaaacacacgactgacgctcaggca |
| | | tcttcccctactccccaacagatccccagaagacagcgtggaaggcagtgtagacag |
| | | taaatcgggcttcagttctatagccaagaagagatcagctgctgaaaccaccagtgg |

TABLE B-continued

| SEQ ID NO | DESCRIPTION | SEQUENCE |
|---|---|---|
| | | gtaccccaggccacctgcctttgaacttggggatttgccatgtttgatcttgtcaca tacttgctttttttacaagatgaactctttgtatttatgatttgggggcaatgaaag gtgcaatgcaggaactgctgctgccgagctcgctggtcacatgggggtgccaggcgg gattctggaaaaccagtgcacttaaactgatcctgaagagagctgtcccagcactct ggccaccaggagggccagattccccagaaactaccttttgcccaaagaacatgctca gtatttggggcatttcctcccacaaaccctgactgcttctgttacctcagggccttg gtacctggatactgccacagaattggggcgggtggggaggggcctattttaaata aaataactgttcaaagttgggggttttttaaaaaattaagaaaaaggaaagctattc tgtattgcaccttttcacaatttaatacattttcttacattttcctgtgattttcga aactaaaccattgtgtgtcctgtagtgtcctggttgagctgccgctcagcagcttcc tcgggggatttggaacacctgtgtctgtcgtcgcactgcctgtgggaggggcccag agggctgctgggactggcgtctgtacacacttgtttggccttttctgtagttgatgc tgtaaactctatggcttttaaaaacgatttcatgttttatttagtattggaaatc caatacactttttaatccaatcaaaaaaaaaaaaaaaaaaaaaa |
| 29 | Mouse NEO1 - NM_001042752 | gccccctcgctctaccgtgaagagcccgagtcggcgacgggtggcggcgcctggaa cctggagagaccgagccaccccccggctctcggccggaatgtactgattctcctctg ctctcctcccgccccgctgcaggaggggaggcgcccggagtctttcccccctgggcgc gcgaggggccgcgcgggccgggccgggccgggctggagccgagccctgccggcgcag agaccggctgaggcgcgctgagggaagggcgcgagcgctccgcggcgctatcgccgc cgccgccgccgccactcgtgggtagagatggcggcggagcgcgaagccgggcgact cctctgcacctcctcctcccggcgctgctgccgccaccgccgctgctgctgttgct gccgctgctgctgctgctcggacgccgcgtccggcgccgcggccacgaagagcgg ctccccgccgcagtccgcaggagccagtgttcgaacattcactccgtttttattttct ggtggagccagtagacaccctctcagttagaggctcttctgttatattaaattgctc ggcatattctgagccctctccaaacattgaatggaagaaagatgggacttttttaaa cttagaatcagatgatcgacgccagctactcccagatggatctttattcatcagcaa cgtggtgcattccaaacacaataagcctgacgaaggtttctatcagtgtgtagccac tgtggataatcttggaaccattgtcagcagaacagccaagctcacagtagcaggtct tccaagatttaccagccaaccagaaccttcttcagtctatgttggaaacagtgcaat tctgaattgtgaagttaatgcagatttggccccatttgttaggtgggaacagaatcg acagccccttcttctagatgacaggattgtcaaacttccaagtggaacactggttat cagcaatgctactgaaggagatgggggactctaccgctgcattgttgaaagtggtgg gccaccaaagtttagtgacgaagctgaattgaaagttcttcaagatcctgaggaaat tgtagacttggtatttctgatgcgaccatcttctatgatgaaagtcactggtcagag tgcagtgttgccatgtgttgtctcagggcttcctgctccagttgttagatggatgaa aaacgaagaagtgcttgacacagaaagctctggcaggttggtcttgctagcaggagg ttgcttggagatcagtgatgtcactgaggatgatgctgggacttattttttgcatagc tgataatgaaataagacagttgaagctcaggcggagcttactgtgcaagtgccacc tggattcctgaaacaacctgctaacatatatgctcacgaatccatagacattgtatt tgaatgtgaagtcactgggaagccaactccaactgtgaagtgggtcaagaatgggga tgtggttatcccagtgattacttttaaaattgtaaaggaacataatcttcaagtttt gggtctggtgaaatcagatgaagggttctatcaatgcattgctgagaatgatgttgg aaatgcacaagctggagcccagctgataatccttgagcatgatgttgccatcccaac attacctcccacttcactgaccagtgccactactgaccatctagccaccagccacaac gggaccattaccttcagctcctcgagacgtcgtggcctccctggtctctactcgctt cattaaattgacatggcgtacacctgcatcagaccctcatggagacaatctcaccta ctctgtgttctacaccaaggaagggttgctagggagcgtgttgagaataccagcca gccaggagagatgcaggtgactattcaaaacttgatgccagcaactgtgtacatctt caaagttatggctcaaaataagcatggctctggagaaagttcagctcctcttcgagt agagacacagcctgaggttcagctccctggcccagcacctaatatccgtgcttatgc aacgtcacctacttctatcactgtcacctgggaaacaccgttatctggcaatgggga aattcaaaattacaaattgtactacatggaaaaaggaactgataaagaacaggatat tgatgtttcaagtcactcctacaccattaatggactgaagaaatacacagaatacag tttccgagtggtggcctacaataaacatggtcctggagtttctacacaagatgttgc tgttcgaacattatcagatgttcccagtgctgctcctcagaatctgtccttagaagt gagaaattcaaagagtatagtgatccactggcagccccttcctcaaccacacaaaa tgggcagataactggctacaagattcgatatcgaaaggcctcccgaaaaagtgatgt cactgagaccttggtaactgggacacagctgtctcagctgattgaaggtcttgatcg ggggacagaatataacttccgagtcgctgctctcacagtcaatggtacaggtccagc aactgattggctgtctgctgaaacttttgaaagcgacctagatgaaactcgtgttcc tgaagtgcccagctctcttcatgtccgtccgctcgtcactagcattgtagtgagctg gactcctcagagaaccagaacattgtggtccgaggtttatgccatcggttacggcat tggcagccctcatgcccagaccatcaaagtggactataaacaacgttattacaccat cgaaaacttggatccaagctctcattacgtgattaccttgaaagcatttaacaatgt tggcgaaggcatcccccttttatgagagtgctgtgaccagacctcacacagtgccaga tcccactcccatgatgccaccagtgggagttcaggcttccattctgagtcacgacac cataaggattacctgggcagacaactccctgcccaaacaccagaagattacagactc ccgctactacagtccggtggaagaccaacatcccagcaaacacgaagtacaagaa tgcaaatgcaacgacgttaagctatttggttactggtttaaagccaaatacgctcta tgagttctctgtgatggtgaccaaaggcagaaggtcaagcgtggagtatgacagc tcatggcgctacctttgaattagttcctacttctccacctaaggatgtgacagttgt gagtaaggaaggaaaacctagaaccatcatagtgaattggcagcctccctctgaagc taacggcaagattacaggttacatcatctattacagcacggatgtgaatgcagagat acatgactgggttattgaaccagttgtgggaaacagactgactcaccagattcaaga gttaacacttgatacgccatactacttcaaaaatccaggcccggaactcaaaggacat |

TABLE B-continued

| SEQ ID NO | DESCRIPTION | SEQUENCE |
|---|---|---|
| | | gggccccatgtctgaagctgtacagttcagaacacctaaagccttagggtcagcagg aaaaggaagccgactaccagacctgggatctgactacaaacctccaatgagtggcag caacagccctcacgggagccccacctcccctctggacagcaacatgctgctggtcat cattgtctctgttggcgtcatcactatcgtggtggttgtggtcattgctgcttttttg tacccggcgcaccacctctcaccagaagaagaaacgagctgcgtgcaaatcagtgaa tggctcccataagtacaagggcaattgcaaagatgtgaagcctccagacctatggat ccatcacgagagactagagttgaagcctattgacaagtctccagatcctaaccctgt catgactgatactccaatccctgaaactctcaagatatcacaccagtggacaattc catggatagcaatatccatcaaaggcggaattcatacagagggcatgagtcagagga cagcatgtctacactggctggaaggaggggaatgagaccaaaaatgatgatgccctt tgactctcagccacctcagcctgtgattagcgcccatcccatccattccctcgataa ccctcaccatcatttccactccagcagcctcgcttctccagcccgcagtcatctcta ccacccaagcagcccatggcccattggcacatccatgtcccttt cagacagggccaa ttccacagaatctgttcgaaataccccagcacggacaccatgccagcgtcctcgtc tcagacgtgctgcactgaccatcaggaccctgagggtgctactagctcctcttactt ggccagctcccaagaggaagactcaggccagagtcttcccacagcccatgtccgccc ttcccacccctctgaagagcttcgctgtgccagcaatcccaccccccaggacctcctct ctatgatcctgcactgccaagcacaccattactgtcccagcaagctctgaaccatca cattcactcagtgaaaacagcctccatcgggacgttaggaaggagccggcctcctat gccagtggttgttccgagtgcccctgaagtacaggagaccaccaggatgctggaaga ctccgagagtagctatgaaccagatgagctgaccaaagagatggcccacctggaagg actaatgaaggacctaaatgccatcacaacagcctgatgaccttcgcctggacatga ctccaagcctgagtctacaagtctcggaacttaaccttgaaaacaaggaattgtaca gagtacgagaggacagcacttgagagcaggagccagcaaaccagccagtgcctccat gtggggttggctccaggcacagccacctgccttctcctggtcagctggattacact tgtgtggaggcagcttccctttgcctgctgagagcctgcaggactgggcactatggg ccaaaattttgtgtccagggaagaggcaagaagtacgacctgcctttt gctttgtgg tcagtggctgtgtctttgtgctgcaactgcatcacttttatggagtgtagacattg gcatttatgtacaattttgtgtcctatttta ttttaccttaaaacactatcagaagc caagggagtctgtgatgttctctcaagcagttgacacttgactgtggttccagttac ttacggaaagtcatcaacagtgaggttgtttgacaccactgacaggcattggcttgt tgtgggtttcattttta ttcttaattctgagacattgcatcctctgccagctgttaa tccatcactttgaggggaggacatgttgcattgctgtttgtaagctttttta ttatt ttttta ttataatta ttaaaggcctgactttctcctctcatcactgtgagatta cag atctatttgaatgaaatgtaacattgaaaagacttgtttgttgctttctgtgtgcagat tcagtattgggtgggattggggattgggaataggaaatggagggggctgctgaggcc ctgtgaatgtttctgtcaatgtactttgttccagaagcctgccgagaatgaaagcag catctttagtgtcctttcctggcatttccatcttcgtgtcaccgcatagcaactgga gttttgtttggatctggttataaaattcttgtacagtggatgactttggtgatttagc tgccctggtatcttggtcatttcctctttggagtgtccacactgaggtctctatcaa tgtatgtttaattgcttgagagatgccaagtagaaccagagcctgactgtgctctga gaagctacaaagcacaggtggagactcccttt gtgttgctagtattggttctctct ggaaggttaaaatctaaggcaggatcttggtttcctattccaaataggatgcctgct tctctgggcaccagtcctcagccaggcagctctcgtggcattgcagaggctctcctg aaaaacatcaaccagggtgagagccaagatggggtggcacccatgacgcttccccac atgtttcttcaaggagcagaggacagagatagtggaaagagggtcagcagaagcagg tgccttcatctatcccagcagctcagccaaaccccagttagaatgaggcagcaggag attccaggtgtgctgagggttcagccacacgcagaagacgttgcagagtgttaaaga ggtaagctgaggtgtgtatttggttggctttgttgttgttgttaatgtataatgaaa agtataagactaaccctcaggcctcatgttctccaatagatccctggaagacagtat agaaagtcagtcgggcttgggctccttagccagtgagactactcagaccaccagtgg ctagcctagcctacctgtccttgaacatgggtgattttacccctttgaggtcttaac cctttttttactttcaacaagatgagctctttgtatgattgcgggcgggggatatga aaatgcaatgatctaactcctgttgctcttctagctggtcacatgacggcaccaggc agggtctgggacacccggtgtgctttgactgttctacaaaaagctgccagagcgtt ctggcctcctggaggctagattcctcagaaactgtctagccttt gcccacagagcat gctatgtaattagagcactccttcccatgaaccccagcacttgtgttacctcagggc cttggtacctggatactgccacagaatttccatgggcgggaagggatgtatttta aataaagtaacttaaaagttggggaaatttttaaattcagaaaatgcaaagctatt ctgtattacaccatttt cacaattta atatgtcttatatttt cctgtgactctggaaa ctaaaccattgtgtgtcttgtcgtgtcctagttgagctggggcctagcagcttcctt ccagtgggtgtggagcaaacgtgtatgtcgcctcgctacctgcttgagggtccgaa gggctgctgggactgagttctgtacacacttgtttggccttttctgtagttgatgct gtaaaactctatggctttta aaaacaatttcatgtttttattttgtattggaagtc caatacactttttta atccaatcaaactggtctggtcaaaaagttcttt cccttaaa agttcaggggctcctacttccagcttccgatgacttctctgtggctctcactgctat aaagcaggatttagaatggcaatctgggcagaggtaacaaaagaaatgtctgactgc cagccccaaaa |

TABLE 2 siRNA targeting HAMP 3'UTR

| Duplex name | SEQ ID NO | Start | Sense (5'-3') | SEQ ID NO | Antisense (5'-3') |
|---|---|---|---|---|---|
| 307-325_s | 307 | 53 | GGAUGUGCUGCAAGACGUA | 96 | UACGUCUUGCAGCACAUCC |
| 309-327_s | 309 | 54 | AUGUGCUGCAAGACGUAGA | 97 | UCUACGUCUUGCAGCACAU |
| 310-328_s | 310 | 55 | UGUGCUGCAAGACGUAGAA | 98 | UUCUACGUCUUGCAGCACA |
| 313-331_s | 313 | 56 | GCUGCAAGACGUAGAACCU | 99 | AGGUUCUACGUCUUGUAGC |
| AD-11439.1_314-332_s | 314 | 57 | CUGCAAGACGUAGAACCUA | 100 | UAGGUUCUACGUCUUGCAG |
| 322-340_s | 322 | 58 | CGUAGAACCUACCUGCCCU | 101 | AGGGCAGGUAGGUUCUACG |
| 347-365_s_G1A | 347 | 59 | GUCCCCUCCCUUCCUUAUU | 102 | AAUAAGGAAGGGAGGGGAC |
| 348-366_s | 348 | 60 | UCCCCUCCCUUCCUUAUUU | 103 | AAAUAAGGAAGGGAGGGGA |
| 349-367_s | 349 | 61 | CCCCUCCCUUCCUUAUUUA | 104 | UAAAUAAGGAAGGGAGGGG |
| 350-368_s | 350 | 62 | CCCUCCCUUCCUUAUUUAU | 105 | AUAAAUAAGGAAGGGAGGG |
| 351-369_s | 351 | 63 | CCUCCCUUCCUUAUUUAUU | 106 | AAUAAAUAAGGAAGGGAGG |
| 352-370_s_C19A | 352 | 64 | CUCCCUUCCUUAUUUAUUA | 107 | UAAUAAAUAAGGAAGGGAG |
| 352-370_s_C19U | 352 | 65 | CUCCCUUCCUUAUUUAUUU | 108 | AAAUAAAUAAGGAAGGGAG |
| 354-372_s | 354 | 66 | CCCUUCCUUAUUUAUUCCU | 109 | AGGAAUAAAUAAGGAAGGG |
| 355-373_s_G19A | 355 | 67 | CCUUCCUUAUUUAUUCCUA | 110 | UAGGAAUAAAUAAGGAAGG |
| 355-373_s_G19U | 355 | 68 | CCUUCCUUAUUUAUUCCUU | 111 | AAGGAAUAAAUAAGGAAGG |
| 356-374_s_C19A | 356 | 69 | CUUCCUUAUUUAUUCCUGA | 112 | UCAGGAAUAAAUAAGGAAG |
| 356-374_s_C19U | 356 | 70 | CUUCCUUAUUUAUUCCUGU | 113 | ACAGGAAUAAAUAAGGAAG |
| 357-375_s | 357 | 71 | UUCCUUAUUUAUUCCUGCU | 114 | AGCAGGAAUAAAUAAGGAA |
| 358-376_s_G19A | 358 | 72 | UCCUUAUUUAUUCCUGCUA | 115 | UAGCAGGAAUAAAUAAGGA |
| 358-376_s_G19U | 358 | 73 | UCCUUAUUUAUUCCUGCUU | 116 | AAGCAGGAAUAAAUAAGGA |
| 359-377_s_C19A | 359 | 74 | CCUUAUUUAUUCCUGCUGA | 117 | UCAGCAGGAAUAAAUAAGG |
| 359-377_s_C19U | 359 | 75 | CCUUAUUUAUUCCUGCUGU | 118 | ACAGCAGGAAUAAAUAAGG |
| 363-381_s | 363 | 76 | AUUUAUUCCUGCUGCCCCA | 119 | UGGGGCAGCAGGAAUAAAU |
| 365-383_s | 365 | 77 | UUAUUCCUGCUGCCCCAGA | 120 | UCUGGGGCAGCAGGAAUAA |
| 366-384_s | 366 | 78 | UAUUCCUGCUGCCCCAGAA | 121 | UUCUGGGGCAGCAGGAAUA |
| 369-387_s | 369 | 79 | UCCUGCUGCCCCAGAACAU | 122 | AUGUUCUGGGGCAGCAGGA |
| 370-388_s | 370 | 80 | CCUGCUGCCCCAGAACAUA | 123 | UAUGUUCUGGGGCAGCAGG |
| 373-391_s | 373 | 81 | GCUGCCCCAGAACAUAGGU | 124 | ACCUAUGUUCUGGGGCAGC |
| 375-393_s | 375 | 82 | UGCCCCAGAACAUAGGUCU | 125 | AGACCUAUGUUCUGGGGCA |
| 376-394_s | 376 | 83 | GCCCCAGAACAUAGGUCUU | 126 | AAGACCUAUGUUCUGGGGC |
| 379-397_s | 379 | 84 | CCAGAACAUAGGUCUUGGA | 127 | UCCAAGACCUAUGUUCUGG |
| 380-398_s | 380 | 85 | CAGAACAUAGGUCUUGGAA | 128 | UUCCAAGACCUAUGUUCUG |
| 381-399_s | 381 | 86 | AGAACAUAGGUCUUGGAAU | 129 | AUUCCAAGACCUAUGUUCU |
| AD-11442.1_382-400_s | 382 | 87 | GAACAUAGGUCUUGGAAUA | 130 | UAUUCCAAGACCUAUGUUC |
| 383-401_s | 383 | 88 | AACAUAGGUCUUGGAAUAA | 131 | UUAUUCCAAGACCUAUGUU |
| 396-414_s | 396 | 89 | GAAUAAAUGGCUGGUUCU | 132 | AGAACCAGCCAUUUAUUC |

TABLE 2-continued siRNA targeting HAMP 3'UTR

| Duplex name | Start | SEQ ID NO | Sense (5'-3') | SEQ ID NO | Antisense (5'-3') |
|---|---|---|---|---|---|
| 398-416_s | 398 | 90 | AUAAAAUGGCUGGUUCUUU | 133 | AAAGAACCAGCCAUUUUAU |
| 399-417_s | 399 | 91 | UAAAAUGGCUGGUUCUUUU | 134 | AAAAGAACCAGCCAUUUUA |
| 402-420_s | 402 | 92 | AAUGGCUGGUUCUUUUGUU | 135 | AACAAAAGAACCAGCCAUU |
| 403-421_s | 403 | 93 | AUGGCUGGUUCUUUUGUUU | 136 | AAACAAAAGAACCAGCCAU |
| 407-425_s | 407 | 94 | CUGGUUCUUUUGUUUUCCA | 137 | UGGAAAACAAAAGAACCAG |
| AD-11436.1_291-309_s | 291 | 95 | CAUCGAUCAAAGUGUGGGA | 138 | UCCCACACUUUGAUCGAUG |

Note that an overhang (e.g. TT, dTsdT) can be added to the 3'end of any duplex.

TABLE 3 siRNA targeting HAMP CDS

| Duplex name | Start | SEQ ID NO | sense (5'-3') | SEQ ID NO | Antisense (5'-3') |
|---|---|---|---|---|---|
| 62-80_s_G19U | 62 | 139 | AGACGGCACGAUGGCACUU | 186 | AAGUGCCAUCGUGCCGUCU |
| 67-85_s_C19A | 67 | 140 | GCACGAUGGCACUGAGCUA | 187 | UAGCUCAGUGCCAUCGUGC |
| 67-85_s_C19U | 67 | 141 | GCACGAUGGCACUGAGCUU | 188 | AAGCUCAGUGCCAUCGUGC |
| 74-92_s_C19A | 74 | 142 | GGCACUGAGCUCCCAGAUA | 189 | UAUCUGGGAGCUCAGUGCC |
| 74-92_s_C19U | 74 | 143 | GGCACUGAGCUCCCAGAUU | 190 | AAUCUGGGAGCUCAGUGCC |
| 76-94_s_G19A | 76 | 144 | CACUGAGCUCCCAGAUCUA | 191 | UAGAUCUGGGAGCUCAGUG |
| 76-94_s_G19U | 76 | 145 | CACUGAGCUCCCAGAUCUU | 192 | AAGAUCUGGGAGCUCAGUG |
| 132-150_s | 132 | 146 | CUGACCAGUGGCUCUGUUU | 193 | AAACAGAGCCACUGGUCAG |
| 140-158_s | 140 | 147 | UGGCUCUGUUUUCCCACAA | 194 | UUGUGGGAAAACAGAGCCA |
| 146-164_s_hcU1C_G19A | 146 | 148 | UGUUUUCCCACAACAGACA | 195 | UGUCUGUUGUGGGAAAACA |
| 146-164_s_hcU1C_G19U | 146 | 149 | UGUUUUCCCACAACAGACU | 196 | AGUCUGUUGUGGGAAAACA |
| 155-173_s | 155 | 150 | ACAACAGACGGGACAACUU | 197 | AAGUUGUCCCGUCUGUUGU |
| 157-175_s_C19A | 157 | 151 | AACAGACGGGACAACUUGA | 198 | UCAAGUUGUCCCGUCUGUU |
| 157-175_s_C19U | 157 | 152 | AGACGGGACAACUUGCAGA | 199 | UCUGCAAGUUGUCCCGUCU |
| 160-178_s | 160 | 153 | AGACGGGACAACUUGCAGA | 200 | UCUGCAAGUUGUCCCGUCU |
| 161-179_s_G19A | 161 | 154 | GACGGGACAACUUGCAGAA | 201 | UUCUGCAAGUUGUCCCGUC |
| 161-179_s_G19U | 161 | 155 | GACGGGACAACUUGCAGAU | 202 | AUCUGCAAGUUGUCCCGUC |
| 162-180_s_C19A | 162 | 156 | ACGGGACAACUUGCAGAGA | 203 | UCUCUGCAAGUUGUCCCGU |
| 162-180_s_C19U | 162 | 157 | ACGGGACAACUUGCAGAGU | 204 | ACUCUGCAAGUUGUCCCGU |
| 242-260_s_C19A | 242 | 158 | GAGGCGAGACACCCACUUA | 205 | UAAGUGGGUGUCUCGCCUC |
| 242-260_s_C19U | 242 | 159 | GAGGCGAGACACCCACUUU | 206 | AAAGUGGGUGUCUCGCCUC |
| 253-271_s | 253 | 160 | CCCACUUCCCCAUCUGCAU | 207 | AUGCAGAUGGGGAAGUGGG |
| 258-276_s | 258 | 161 | UUCCCCAUCUGCAUUUUCU | 208 | AGAAAAUGCAGAUGGGGAA |
| 261-279_s | 261 | 162 | CCCAUCUGCAUUUUCUGCU | 209 | AGCAGAAAAUGCAGAUGGG |
| 275-293_s | 275 | 163 | CUGCUGCGGCUGCUGUCAU | 210 | AUGACAGCAGCCGCAGCAG |

TABLE 3-continued siRNA targeting HAMP CDS

| Duplex name | Start | SEQ ID NO | sense (5'-3') | SEQ ID NO | Antisense (5'-3') |
|---|---|---|---|---|---|
| 276-294_s_C19A | 276 | 164 | UGCUGCGGCUGCUGUCAUA | 211 | UAUGACAGCAGCCGCAGCA |
| 276-294_s_C19U | 276 | 165 | UGCUGCGGCUGCUGUCAUU | 212 | AAUGACAGCAGCCGCAGCA |
| 278-296_s | 278 | 166 | CUGCGGCUGCUGUCAUCGA | 213 | UCGAUGACAGCAGCCGCAG |
| 279-297_s | 279 | 167 | UGCGGCUGCUGUCAUCGAU | 214 | AUCGAUGACAGCAGCCGCA |
| 280-298_s_C19A | 280 | 168 | GCGGCUGCUGUCAUCGAUA | 215 | UAUCGAUGACAGCAGCCGC |
| 280-298_s_C19U | 280 | 169 | GCGGCUGCUGUCAUCGAUU | 216 | AAUCGAUGACAGCAGCCGC |
| 281-299_s | 281 | 170 | CGGCUGCUGUCAUCGAUCA | 217 | UGAUCGAUGACAGCAGCCG |
| AD-11443.1_282-300_s | 282 | 171 | GGCUGCUGUCAUCGAUCAA | 218 | UUGAUCGAUGACAGCAGCC |
| AD-11432.1_283-301_s | 283 | 172 | GCUGCUGUCAUCGAUCAAA | 219 | UUUGAUCGAUGACAGCAGC |
| 284-302_s_G19A | 284 | 173 | CUGCUGUCAUCGAUCAAAA | 220 | UUUUGAUCGAUGACAGCAG |
| 284-302_s_G19U | 284 | 174 | CUGCUGUCAUCGAUCAAAU | 221 | AUUUGAUCGAUGACAGCAG |
| AD-11441.1_285-303_s | 285 | 175 | UGCUGUCAUCGAUCAAAGU | 222 | ACUUUGAUCGAUGACAGCA |
| 286-304_s_G19A | 286 | 176 | GCUGUCAUCGAUCAAAGUA | 223 | UACUUUGAUCGAUGACAGC |
| 286-304_s_G19U | 286 | 177 | GCUGUCAUCGAUCAAAGUU | 224 | AACUUUGAUCGAUGACAGC |
| AD-11447.1_297-305_s | 287 | 178 | CUGUCAUCGAUCAAAGUGU | 225 | ACACUUUGAUCGAUGACAG |
| 288-306_s_G19A | 288 | 179 | UGUCAUCGAUCAAAGUGUA | 226 | UACACUUUGAUCGAUGACA |
| 288-306_s_G19U | 288 | 180 | UGUCAUCGAUCAAAGUGUU | 227 | AACACUUUGAUCGAUGACA |
| 290-308_s_G19A | 290 | 181 | UCAUCGAUCAAAGUGUGGA | 228 | UCCACACUUUGAUCGAUGA |
| 290-308_s_G19U | 290 | 182 | UCAUCGAUCAAAGUGUGGU | 229 | ACCACACUUUGAUCGAUGA |
| 295-313_s_G19A | 295 | 183 | GAUCAAAGUGUGGGAUGUA | 230 | UACAUCCCACACUUUGAUC |
| 295-313_s_G19U | 295 | 184 | GAUCAAAGUGUGGGAUGUU | 231 | AACAUCCCACACUUUGAUC |
| 299-317_s_C19U | 299 | 185 | AAAGUGUGGGAUGUGCUGU | 232 | ACAGCACAUCCCACACUUU |

Note that an overhang (e.g. TT, dTsdT) can be added to the 3'end of any duplex.

TABLE 4

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45073 | 2 | A-94166.1 | AcuGucAcucGGucccAGAdTsdT | 233 | A-94167.1 | UCUGGGACCGAGUGAcAGUdTsdT | 458 |
| HAMP | AD-45079 | 7 | A-94168.1 | cAcucGGucccAGAcAccAdTsdT | 234 | A-94169.1 | UGGUGUCUGGGACCGAGUGdTsdT | 459 |
| HAMP | AD-45085 | 16 | A-94170.1 | ccAGAcAccAGAGcAAGcudTsdT | 235 | A-94171.1 | AGCUUGCUCUGGUGUCUGGdTsdT | 460 |
| HAMP | AD-29928 | 43 | A-66808.1 | AGcAGuGGGAcAGccAGAcdTsdT | 236 | A-66809.1 | GUCUGGCUGUCCcACUGCUdTsdT | 461 |
| HAMP | AD-45674 | 43 | A-95618.1 | AGcAGuGGGAcAGccAGAAdTsdT | 237 | A-95619.1 | UUCUGGCUGUCCcACUGCUdTsdT | 462 |
| HAMP | AD-45680 | 43 | A-95620.1 | AGcAGuGGGAcAGccAGAudTsdT | 238 | A-95621.1 | AUCUGGCUGUCCcACUGCUdTsdT | 463 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45686 | 48 | A-95622.1 | uGGGAcAGccAGAcAGAcGdTsdT | 239 | A-95623.1 | CGUCUGUCUGGCUGUCCcAdTsdT | 464 |
| HAMP | AD-45698 | 48 | A-95626.1 | uGGGAcAGccAGAcAGAcudTsdT | 240 | A-95627.1 | AGUCUGUCUGGCUGUCCcAdTsdT | 465 |
| HAMP | AD-45692 | 48 | A-95624.1 | uGGGAcAGccAGAcAGAcAdTsdT | 241 | A-95625.1 | UGUCUGUCUGGCUGUCCcAdTsdT | 466 |
| HAMP | AD-45354 | 51 | A-94701.1 | GAcAGccAGAcAGAcGcAdTsdT | 242 | A-94702.1 | UGCCGUCUGUCUGGCUGUCdTsdT | 467 |
| HAMP | AD-29929 | 54 | A-66810.1 | AGccAGAcAGAcGGcAcGAdTsdT | 243 | A-66811.1 | UCGUGCCGUCUGUCUGGCUdTsdT | 468 |
| HAMP | AD-45091 | 55 | A-94172.1 | GccAGAcAGAcGGcAcGAudTsdT | 244 | A-94173.1 | AUCGUGCCGUCUGUCUGGCdTsdT | 469 |
| HAMP | AD-29930 | 59 | A-66812.1 | GAcAGAcGGcAcGAuGGcAdTsdT | 245 | A-66813.1 | UGCcAUCGUGCCGUCUGUCdTsdT | 470 |
| HAMP | AD-29931 | 60 | A-66814.1 | AcAGAcGGcAcGAuGGcAcdTsdT | 246 | A-66815.1 | GUGCcAUCGUGCCGUCUGUdTsdT | 471 |
| HAMP | AD-45704 | 60 | A-95628.1 | AcAGAcGGcAcGAuGGcAAdTsdT | 247 | A-95629.1 | UUGCcAUCGUGCCGUCUGUdTsdT | 472 |
| HAMP | AD-45710 | 60 | A-95630.1 | AcAGAcGGcAcGAuGGcAudTsdT | 248 | A-95631.1 | AUGCcAUCGUGCCGUCUGUdTsdT | 473 |
| HAMP | AD-29932 | 61 | A-66816.1 | cAGAcGGcAcGAuGGcAcudTsdT | 249 | A-66817.1 | AGUGCcAUCGUGCCGUCUGdTsdT | 474 |
| HAMP | AD-47030 | 62 | A-98344.1 | AGACfGGCfACfGAUfGGCfACfUfUfdTsdT | 250 | A-98345.1 | AAGUGCCfAUCGUGCCGUCUdTsdT | 475 |
| HAMP | AD-29933 | 62 | A-66818.1 | AGAcGGcAcGAuGGcAcuGdTsdT | 251 | A-66819.1 | cAGUGCcAUCGUGCCGUCUdTsdT | 476 |
| HAMP | AD-45675 | 62 | A-95634.1 | AGAcGGcAcGAuGGcAcuudTsdT | 250 | A-95635.1 | AAGUGCcAUCGUGCCGUCUdTsdT | 475 |
| HAMP | AD-45716 | 62 | A-95632.1 | AGAcGGcAcGAuGGcAcuAdTsdT | 252 | A-95633.1 | uAGUGCcAUCGUGCCGUCUdTsdT | 477 |
| HAMP | AD-29934 | 63 | A-66820.1 | GAcGGcAcGAuGGcAcuGAdTsdT | 253 | A-66821.1 | UcAGUGCcAUCGUGCCGUCdTsdT | 478 |
| HAMP | AD-29935 | 64 | A-66822.1 | AcGGcAcGAuGGcAcuGAGdTsdT | 254 | A-66823.1 | CUcAGUGCcAUCGUGCCGUdTsdT | 479 |
| HAMP | AD-45687 | 64 | A-95638.1 | AcGGcAcGAuGGcAcuGAudTsdT | 255 | A-95639.1 | AUcAGUGCcAUCGUGCCGUdTsdT | 480 |
| HAMP | AD-45681 | 64 | A-95636.1 | AcGGcAcGAuGGcAcuGAAdTsdT | 256 | A-95637.1 | UUcAGUGCcAUCGUGCCGUdTsdT | 481 |
| HAMP | AD-29936 | 66 | A-66824.1 | GGcAcGAuGGcAcuGAGcudTsdT | 257 | A-66825.1 | AGCUcAGUGCcAUCGUGCCdTsdT | 482 |
| HAMP | AD-47043 | 67 | A-98348.1 | GCfACfGAUfGGCfACfUfGAGCfUfUfdTsdT | 258 | A-98349.1 | AAGCUCfAGUGCCfAUCGUGCdTsdT | 483 |
| HAMP | AD-47037 | 67 | A-98346.1 | GCfACfGAUfGGCfACfUfGAGCfUfAdTsdT | 259 | A-98347.1 | CfAGCUCfAGUGCCfAUCGUGCdTsdT | 484 |
| HAMP | AD-29937 | 67 | A-66826.1 | GcAcGAuGGcAcuGAGcucdTsdT | 260 | A-66827.1 | GAGCUcAGUGCcAUCGUGCdTsdT | 485 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45699 | 67 | A-95642.1 | GcAcGAuGGcAcuGAGcuudTsdT | 258 | A-95643.1 | AAGCUcAGUGCcAUCGUGCdTsdT | 483 |
| HAMP | AD-45693 | 67 | A-95640.1 | GcAcGAuGGcAcuGAGcuAdTsdT | 259 | A-95641.1 | uAGCUcAGUGCcAUCGUGCdTsdT | 486 |
| HAMP | AD-45711 | 68 | A-95646.1 | cAcGAuGGcAcuGAGcucAdTsdT | 261 | A-95647.1 | UGAGCUcAGUGCcAUCGUGdTsdT | 487 |
| HAMP | AD-45717 | 68 | A-95648.1 | cAcGAuGGcAcuGAGcucudTsdT | 262 | A-95649.1 | AGAGCUcAGUGCcAUCGUGdTsdT | 488 |
| HAMP | AD-45705 | 68 | A-95644.1 | cAcGAuGGcAcuGAGcuccdTsdT | 263 | A-95645.1 | GGAGCUcAGUGCcAUCGUGdTsdT | 489 |
| HAMP | AD-45682 | 69 | A-95652.1 | AcGAuGGcAcuGAGcuccAdTsdT | 264 | A-95653.1 | UGGAGCUcAGUGCcAUCGUGdTsdT | 490 |
| HAMP | AD-45688 | 69 | A-95654.1 | AcGAuGGcAcuGAGcuccudTsdT | 265 | A-95655.1 | AGGAGCUcAGUGCcAUCGUGdTsdT | 491 |
| HAMP | AD-45676 | 69 | A-95650.1 | AcGAuGGcAcuGAGcucccdTsdT | 266 | A-95651.1 | GGGAGCUcAGUGCcAUCGUGdTsdT | 492 |
| HAMP | AD-45360 | 70 | A-94703.1 | cGAuGGcAcuGAGcucccAdTsdT | 267 | A-94704.1 | UGGGAGCUcAGUGCcAUCGUdTsdT | 493 |
| HAMP | AD-45366 | 71 | A-94705.1 | GAuGGcAcuGAGcucccAGdTsdT | 268 | A-94706.1 | CUGGGAGCUcAGUGCcAUCdTsdT | 494 |
| HAMP | AD-29938 | 72 | A-66828.1 | AuGGcAcuGAGcucccAGAdTsdT | 269 | A-66829.1 | UCUGGGAGCUcAGUGCcAUdTsdT | 495 |
| HAMP | AD-45372 | 73 | A-94707.1 | uGGcAcuGAGcucccAGAudTsdT | 270 | A-94708.1 | AUCUGGGAGCUcAGUGCcAdTsdT | 496 |
| HAMP | AD-47055 | 74 | A-98352.1 | GGCfACfUfGAGCfUfCfCfCfAGAUfUfdTsdT | 271 | A-98353.1 | AAUCUGGGAGCUCfAGUGCCdTsdT | 497 |
| HAMP | AD-47049 | 74 | A-98350.1 | GGCfACfUfGAGCfUfCfCfCfAGAUfAdTsdT | 272 | A-98351.1 | CfAUCUGGGAGCUCfAGUGCCdTsdT | 498 |
| HAMP | AD-45700 | 74 | A-95658.1 | GGcAcuGAGcucccAGAuudTsdT | 271 | A-95659.1 | AAUCUGGGAGCUcAGUGCCdTsdT | 497 |
| HAMP | AD-29939 | 74 | A-66830.1 | GGcAcuGAGcucccAGAucdTsdT | 273 | A-66831.1 | GAUCUGGGAGCUcAGUGCCdTsdT | 499 |
| HAMP | AD-45694 | 74 | A-95656.1 | GGcAcuGAGcucccAGAuAdTsdT | 272 | A-95657.1 | uAUCUGGGAGCUcAGUGCCdTsdT | 500 |
| HAMP | AD-29940 | 75 | A-66832.1 | GcAcuGAGcucccAGAucudTsdT | 274 | A-66833.1 | AGAUCUGGGAGCUcAGUGCdTsdT | 501 |
| HAMP | AD-47067 | 76 | A-98356.1 | CfACfUfGAGCfUfCfCfCfAGAUfCfUfUfdTsdT | 275 | A-98357.1 | AAGAUCUGGGAGCUCfAGUGdTsdT | 502 |
| HAMP | AD-47061 | 76 | A-98354.1 | CfACfUfGAGCfUfCfCfCfAGAUfCfUfAdTsdT | 276 | A-98355.1 | CfAGAUCUGGGAGCUCfAGUGdTsdT | 503 |
| HAMP | AD-45712 | 76 | A-95662.1 | cAcuGAGcucccAGAucuudTsdT | 275 | A-95663.1 | AAGAUCUGGGAGCUcAGUGdTsdT | 502 |
| HAMP | AD-29941 | 76 | A-66834.1 | cAcuGAGcucccAGAucuGdTsdT | 277 | A-66835.1 | cAGAUCUGGGAGCUcAGUGdTsdT | 503 |
| HAMP | AD-45706 | 76 | A-95660.1 | cAcuGAGcucccAGAucuAdTsdT | 276 | A-95661.1 | uAGAUCUGGGAGCUcAGUGdTsdT | 504 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45097 | 88 | A-94174.1 | AGAucuGGGccGcuuGccudTsdT | 278 | A-94175.1 | AGGcAAGCGGCCcAGAUCUdTsdT | 505 |
| HAMP | AD-45103 | 91 | A-94176.1 | ucuGGGccGcuuGccuccudTsdT | 279 | A-94177.1 | AGGAGGcAAGCGGCCcAGAdTsdT | 506 |
| HAMP | AD-45378 | 116 | A-94709.1 | ccuccuccucGcCAGccuGdTsdT | 280 | A-94710.1 | cAGGCUGGCGAGGAGGAGGdTsdT | 507 |
| HAMP | AD-45383 | 117 | A-94711.1 | cuccuccucGccAGccuGAdTsdT | 281 | A-94712.1 | UcAGGCUGGCGAGGAGGAGdTsdT | 508 |
| HAMP | AD-45388 | 118 | A-94713.1 | uccuccucGccAGccuGAcdTsdT | 282 | A-94714.1 | GUcAGGCUGGCGAGGAGGAdTsdT | 509 |
| HAMP | AD-45393 | 120 | A-94715.1 | cuccucGccAGccuGAccAdTsdT | 283 | A-94716.1 | UGGUcAGGCUGGCGAGGAGdTsdT | 510 |
| HAMP | AD-45355 | 121 | A-94717.1 | uccucGccAGccuGAccAGdTsdT | 284 | A-94718.1 | CUGGUcAGGCUGGCGAGGAdTsdT | 511 |
| HAMP | AD-45361 | 122 | A-94719.1 | ccucGccAGccuGAccAGudTsdT | 285 | A-94720.1 | ACUGGUcAGGCUGGCGAGGdTsdT | 512 |
| HAMP | AD-45367 | 123 | A-94721.1 | cucGccAGccuGAccAGuGdTsdT | 286 | A-94722.1 | cACUGGUcAGGCUGGCGAGdTsdT | 513 |
| HAMP | AD-45373 | 126 | A-94723.1 | GccAGccuGAccAGuGGcudTsdT | 287 | A-94724.1 | AGCcACUGGUcAGGCUGGCdTsdT | 514 |
| HAMP | AD-45109 | 132 | A-94178.1 | cuGAccAGuGGcucuGuuudTsdT | 288 | A-94179.1 | AAAcAGAGCcACUGGUcAGdTsdT | 515 |
| HAMP | AD-47032 | 140 | A-98360.1 | UfGGCfUfCfUfGUfUfUfCfCfCfACfAAdTsdT | 289 | A-98361.1 | UUGUGGGAAAACfAGAGCCAdTsdT | 516 |
| HAMP | AD-45115 | 140 | A-94180.1 | uGGcucuGuuuucccAcAAdTsdT | 289 | A-94181.1 | UUGUGGGAAAAcAGAGCcAdTsdT | 516 |
| HAMP | AD-45074 | 142 | A-94182.1 | GcucuGuuuucccAcAAcAdTsdT | 290 | A-94183.1 | UGUUGUGGGAAAAcAGAGCdTsdT | 517 |
| HAMP | AD-47038 | 146 | A-98362.1 | UfGUfUfUfUfCfCfCfACfAACfAGACfAdTsdT | 291 | A-98363.1 | UGUCUGUUGUGGGAAAACfAdTsdT | 518 |
| HAMP | AD-47044 | 146 | A-98364.1 | UfGUfUfUfUfCfCfCfACfAACfAGACfUfdTsdT | 292 | A-98365.1 | AGUCUGUUGUGGGAAAACfAdTsdT | 519 |
| HAMP | AD-45677 | 146 | A-95666.1 | uGuuuucccAcAAcAGAcAdTsdT | 291 | A-95667.1 | UGUCUGUUGUGGGAAAAcAdTsdT | 518 |
| HAMP | AD-45683 | 146 | A-95668.1 | uGuuuucccAcAAcAGAcudTsdT | 292 | A-95669.1 | AGUCUGUUGUGGGAAAAcAdTsdT | 519 |
| HAMP | AD-45718 | 146 | A-95664.1 | uGuuuucccAcAAcAGAcGdTsdT | 293 | A-95665.1 | CGUCUGUUGUGGGAAAAcAdTsdT | 520 |
| HAMP | AD-45080 | 149 | A-94184.1 | uuucccAcAAcAGAcGGGAdTsdT | 294 | A-94185.1 | UCCCGUCUGUUGUGGGAAAdTsdT | 521 |
| HAMP | AD-45379 | 150 | A-94725.1 | uucccAcAAcAGAcGGGAcdTsdT | 295 | A-94726.1 | GUCCCGUCUGUUGUGGGAAdTsdT | 522 |
| HAMP | AD-29942 | 151 | A-66836.1 | ucccAcAAcAGAcGGGAcAdTsdT | 296 | A-66837.1 | UGUCCCGUCUGUUGUGGGAdTsdT | 523 |
| HAMP | AD-29943 | 152 | A-66838.1 | cccAcAAcAGAcGGGAcAAdTsdT | 297 | A-66839.1 | UUGUCCCGUCUGUUGUGGGdTsdT | 524 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-29944 | 153 | A-66840.1 | ccAcAAcAGAcG GGAcAAcdTsdT | 298 | A-15142.2 | GUUGUCCCGUCU GUUGUGGdTsdT | 525 |
| HAMP | AD-45695 | 153 | A-95672.1 | ccAcAAcAGAcG GGAcAAudTsdT | 299 | A-95673.1 | AUUGUCCCGUCU GUUGUGGdTsdT | 526 |
| HAMP | AD-45689 | 153 | A-95670.1 | ccAcAAcAGAcG GGAcAAAdTsdT | 300 | A-95671.1 | UUUGUCCCGUCU GUUGUGGdTsdT | 527 |
| HAMP | AD-29945 | 154 | A-66841.1 | cAcAAcAGAcGG GAcAAcudTsdT | 301 | A-15116.1 | AGUUGUCCCGUC UGUUGUGGdTsdT | 528 |
| HAMP | AD-47050 | 155 | A-98366.1 | ACfAACfAGACf GGGACfAACfUf UfdTsdT | 302 | A-15182.3 | AAGUUGUCCCGU CUGUUGUdTsdT | 529 |
| HAMP | AD-29946 | 155 | A-66842.1 | AcAAcAGAcGGG AcAAcuudTsdT | 302 | A-15182.1 | AAGUUGUCCCGU CUGUUGUdTsdT | 529 |
| HAMP | AD-47062 | 157 | A-98369.1 | AACfAGACfGGG ACfAACfUfUfG UfdTsdT | 303 | A-98370.1 | ACfAAGUUGUCC CGUCUGUUdTsd T | 530 |
| HAMP | AD-47056 | 157 | A-98367.1 | AACfAGACfGGG ACfAACfUfUfG AdTsdT | 304 | A-98368.1 | UCfAAGUUGUCC CGUCUGUUdTsd T | 531 |
| HAMP | AD-45713 | 157 | A-95678.1 | AAcAGAcGGGAc AAcuuGudTsdT | 303 | A-95679.1 | AcAAGUUGUCCC GUCUGUUdTsdT | 530 |
| HAMP | AD-45707 | 157 | A-95676.1 | AAcAGAcGGGAc AAcuuGAdTsdT | 304 | A-95677.1 | UcAAGUUGUCCC GUCUGUUdTsdT | 531 |
| HAMP | AD-45701 | 157 | A-95674.1 | AAcAGAcGGGAc AAcuuGcdTsdT | 305 | A-95675.1 | GcAAGUUGUCCC GUCUGUUdTsdT | 532 |
| HAMP | AD-45394 | 159 | A-94727.1 | cAGAcGGGAcAA cuuGcAGdTsdT | 306 | A-94728.1 | CUGcAAGUUGUC CCGUCUGdTsdT | 533 |
| HAMP | AD-47068 | 160 | A-98371.1 | AGAcfGGGACfA ACfUfUfGCfAG AdTsdT | 307 | A-98372.1 | UCUGCfAAGUUG UCCCGUCUdTsd T | 534 |
| HAMP | AD-45389 | 160 | A-94729.1 | AGAcGGGAcAAc uuGcAGAdTsdT | 307 | A-94730.1 | UCUGcAAGUUGU CCCGUCUdTsdT | 534 |
| HAMP | AD-47033 | 161 | A-98375.1 | GACfGGGACfAA CfUfUfGCfAGA UfdTsdT | 308 | A-98376.1 | AUCUGCfAAGUU GUCCCGUCdTsd T | 535 |
| HAMP | AD-47074 | 161 | A-98373.1 | GACfGGGACfAA CfUfUfGCfAGA AdTsdT | 309 | A-98374.1 | UUCUGCfAAGUU GUCCCGUCdTsd T | 536 |
| HAMP | AD-45678 | 161 | A-95682.1 | GAcGGGAcAAcu uGcAGAudTsdT | 308 | A-95683.1 | AUCUGcAAGUUG UCCCGUCdTsdT | 535 |
| HAMP | AD-45719 | 161 | A-95680.1 | GAcGGGAcAAcu uGcAGAAdTsdT | 309 | A-95681.1 | UUCUGcAAGUUG UCCCGUCdTsdT | 536 |
| HAMP | AD-29947 | 161 | A-66843.1 | GAcGGGAcAAcu uGcAGAGdTsdT | 310 | A-66844.1 | CUCUGcAAGUUG UCCCGUCdTsdT | 537 |
| HAMP | AD-47039 | 162 | A-98377.1 | ACfGGGACfAAC fUfUfGCfAGAG AdTsdT | 311 | A-98378.1 | UCUCUGCfAAGU UGUCCCGUdTsd T | 538 |
| HAMP | AD-47045 | 162 | A-98379.1 | ACfGGGACfAAC fUfUfGCfAGAG UfdTsdT | 312 | A-98380.1 | ACUCUGCfAAGU UGUCCCGUdTsd T | 539 |
| HAMP | AD-45690 | 162 | A-95686.1 | AcGGGAcAAcuu GcAGAGAdTsdT | 311 | A-95687.1 | UCUCUGcAAGUU GUCCCGUdTsdT | 538 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45696 | 162 | A-95688.1 | AcGGGAcAAcuuGcAGAGudTsdT | 312 | A-95689.1 | ACUCUGcAAGUUGUCCCGUdTsdT | 539 |
| HAMP | AD-45684 | 162 | A-95684.1 | AcGGGAcAAcuuGcAGAGcdTsdT | 313 | A-95685.1 | GCUCUGcAAGUUGUCCCGUdTsdT | 540 |
| HAMP | AD-30016 | 163 | A-66845.1 | cGGGAcAAcuuGcAGAGcudTsdT | 314 | A-66846.1 | AGCUCUGcAAGUUGUCCCGdTsdT | 541 |
| HAMP | AD-45394 | 164 | A-94731.1 | GGGAcAAcuuGcAGAGcuGdTsdT | 315 | A-94732.1 | cAGCUCUGcAAGUUGUCCCdTsdT | 542 |
| HAMP | AD-45702 | 165 | A-95690.1 | GGAcAAcuuGcAGAGcuGcdTsdT | 316 | A-95691.1 | GcAGCUCUGcAAGUUGUCCdTsdT | 543 |
| HAMP | AD-45708 | 165 | A-95692.1 | GGAcAAcuuGcAGAGcUGAdTsdT | 317 | A-95693.1 | UcAGCUCUGcAAGUUGUCCdTsdT | 544 |
| HAMP | AD-45714 | 165 | A-95694.1 | GGAcAAcuuGcAGAGcuGudTsdT | 318 | A-95695.1 | AcAGCUCUGcAAGUUGUCCdTsdT | 545 |
| HAMP | AD-29949 | 166 | A-66847.1 | GAcAAcuuGcAGAGcuGcAdTsdT | 319 | A-66848.1 | UGcAGCUCUGcAAGUUGUCdTsdT | 546 |
| HAMP | AD-45086 | 167 | A-94186.1 | AcAAcuuGcAGAGcuGcAAdTsdT | 320 | A-94187.1 | UUGcAGCUCUGcAAGUUGUdTsdT | 547 |
| HAMP | AD-45356 | 168 | A-94733.1 | cAAcuuGcAGAGcuGcAAcdTsdT | 321 | A-94734.1 | GUUGcAGCUCUGcAAGUUGdTsdT | 548 |
| HAMP | AD-45685 | 169 | A-95700.1 | AAcuuGcAGAGcuGcAAcudTsdT | 322 | A-95701.1 | AGUUGcAGCUCUGcAAGUUdTsdT | 549 |
| HAMP | AD-45679 | 169 | A-95698.1 | AAcuuGcAGAGcuGcAAcAdTsdT | 323 | A-95699.1 | UGUUGcAGCUCUGcAAGUUdTsdT | 550 |
| HAMP | AD-45720 | 169 | A-95696.1 | AAcuuGcAGAGcuGcAAccdTsdT | 324 | A-95697.1 | GGUUGcAGCUCUGcAAGUUdTsdT | 551 |
| HAMP | AD-45703 | 170 | A-95706.1 | AcuuGcAGAGcuGcAAccudTsdT | 325 | A-95707.1 | AGGUUGcAGCUCUGcAAGUdTsdT | 552 |
| HAMP | AD-45697 | 170 | A-95704.1 | AcuuGcAGAGcuGcAAccAdTsdT | 326 | A-95705.1 | UGGUUGcAGCUCUGcAAGUdTsdT | 553 |
| HAMP | AD-45691 | 170 | A-95702.1 | AcuuGcAGAGcuGcAAcccdTsdT | 327 | A-95703.1 | GGGUUGcAGCUCUGcAAGUdTsdT | 554 |
| HAMP | AD-45362 | 189 | A-94735.1 | cAGGAcAGAGcuGGAGccAdTsdT | 328 | A-94736.1 | UGGCUCcAGCUCUGUCCUGdTsdT | 555 |
| HAMP | AD-45368 | 190 | A-94737.1 | AGGAcAGAGcuGGAGccAGdTsdT | 329 | A-94738.1 | CUGGCUCcAGCUCUGUCCUdTsdT | 556 |
| HAMP | AD-45374 | 199 | A-94739.1 | cuGGAGccAGGGccAGcuGdTsdT | 330 | A-94740.1 | cAGCUGGCCCUGGCUCcAGdTsdT | 557 |
| HAMP | AD-45092 | 222 | A-94188.1 | cccAuGuuccAGAGGcGAAdTsdT | 331 | A-94189.1 | UUCGCCUCUGGAAcAUGGGdTsdT | 558 |
| HAMP | AD-45721 | 228 | A-95712.1 | uuccAGAGGcGAAGGAGGudTsdT | 332 | A-95713.1 | ACCUCCUUCGCCUCUGGAAdTsdT | 559 |
| HAMP | AD-45715 | 228 | A-95710.1 | uuccAGAGGcGAAGGAGGAdTsdT | 333 | A-95711.1 | UCCUCCUUCGCCUCUGGAAdTsdT | 560 |
| HAMP | AD-45709 | 228 | A-95708.1 | uuccAGAGGcGAAGGAGGcdTsdT | 334 | A-95709.1 | GCCUCCUUCGCCUCUGGAAdTsdT | 561 |
| HAMP | AD-45380 | 230 | A-94741.1 | ccAGAGGcGAAGGAGGcGAdTsdT | 335 | A-94742.1 | UCGCCUCCUUCGCCUCUGGdTsdT | 562 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45385 | 231 | A-94743.1 | cAGAGGcGAAGG AGGcGAGdTsdT | 336 | A-94744.1 | CUCGCCUCCUUC GCCUCUGdTsdT | 563 |
| HAMP | AD-29950 | 232 | A-66849.1 | AGAGGcGAAGGA GGcGAGAdTsdT | 337 | A-66850.1 | UCUCGCCUCCUU CGCCUCUdTsdT | 564 |
| HAMP | AD-45390 | 233 | A-94745.1 | GAGGcGAAGGAG GcGAGAcdTsdT | 338 | A-94746.1 | GUCUCGCCUCCU UCGCCUCdTsdT | 565 |
| HAMP | AD-29951 | 234 | A-66851.1 | AGGcGAAGGAGG cGAGAcAdTsdT | 339 | A-66852.1 | UGUCUCGCCUCC UUCGCCUdTsdT | 566 |
| HAMP | AD-45395 | 235 | A-94747.1 | GGcGAAGGAGGc GAGAcAcdTsdT | 340 | A-94748.1 | GUGUCUCGCCUC CUUCGCCdTsdT | 567 |
| HAMP | AD-45727 | 239 | A-95714.1 | AAGGAGGcGAGA cAcccAAdTsdT | 341 | A-95715.1 | UUGGGUGUCUCG CCUCCUUdTsdT | 568 |
| HAMP | AD-45732 | 239 | A-95716.1 | AAGGAGGcGAGA cAcccAudTsdT | 342 | A-95717.1 | AUGGGUGUCUCG CCUCCUUdTsdT | 569 |
| HAMP | AD-29952 | 239 | A-66853.1 | AAGGAGGcGAGA cAcccAcdTsdT | 343 | A-66854.1 | GUGGGUGUCUCG CCUCCUUdTsdT | 570 |
| HAMP | AD-29953 | 240 | A-66855.1 | AGGAGGcGAGAc AcccAcudTsdT | 344 | A-66856.1 | AGUGGGUGUCUC GCCUCCUdTsdT | 571 |
| HAMP | AD-30017 | 241 | A-66857.1 | GGAGGcGAGAcA cccAcuudTsdT | 345 | A-66858.1 | AAGUGGGUGUCU CGCCUCCdTsdT | 572 |
| HAMP | AD-47057 | 242 | A-98383.1 | GAGGCfGAGACf ACfCfCfACfUf UfUfdTsdT | 346 | A-95721.2 | AAAGUGGGUGUC UCGCCUCdTsdT | 573 |
| HAMP | AD-47051 | 242 | A-98381.1 | GAGGCfGAGACf ACfCfCfACfUf UfAdTsdT | 347 | A-98382.1 | CfAAGUGGGUGU CUCGCCUCdTsd T | 574 |
| HAMP | AD-30018 | 242 | A-66859.1 | GAGGcGAGAcAc ccAcuucdTsdT | 348 | A-66860.1 | GAAGUGGGUUCG CCUCGUCdTsdT | 575 |
| HAMP | AD-45737 | 242 | A-95718.1 | GAGGcGAGAcAc ccAcuuAdTsdT | 347 | A-95719.1 | uAAGUGGGUGUC UCGCCUCdTsdT | 576 |
| HAMP | AD-29956 | 246 | A-66861.1 | cGAGAcAcccAc uuccccAdTsdT | 349 | A-66862.1 | UGGGGAAGUGGG UGUCUCGdTsdT | 577 |
| HAMP | AD-45357 | 247 | A-94749.1 | GAGAcAcccAcu ucccAudTsdT | 350 | A-94750.1 | AUGGGGAAGUGG GUGUCUCdTsdT | 578 |
| HAMP | AD-45363 | 248 | A-94751.1 | AGAcAcccAcuu ccccAucdTsdT | 351 | A-94752.1 | GAUGGGGAAGUG GGUGUCUdTsdT | 579 |
| HAMP | AD-45747 | 251 | A-95722.1 | cAcccAcuuccc cAucuGcdTsdT | 352 | A-95723.1 | GcAGAUGGGGAA GUGGGUGdTsdT | 580 |
| HAMP | AD-45752 | 251 | A-95724.1 | cAcccAcuuccc cAucuGAdTsdT | 353 | A-95725.1 | UcAGAUGGGAAG UGGGUGdTsdT | 581 |
| HAMP | AD-45757 | 251 | A-95726.1 | cAcccAcuuccc cAucuGudTsdT | 354 | A-95727.1 | AcAGAUGGGGAA GUGGGUGdTsdT | 582 |
| HAMP | AD-29957 | 252 | A-66863.1 | AcccAcuucccc AucuGcAdTsdT | 355 | A-66864.1 | UGcAGAUGGGGA AGUGGGUdTsdT | 583 |
| HAMP | AD-47063 | 253 | A-98384.1 | CfCfCfACfUfU fCfCfCfCfAUf CfUfGCfAUfdT sdT | 356 | A-98385.1 | AUGCfAGAUGGG GAAGUGGGdTsd T | 584 |
| HAMP | AD-45399 | 253 | A-94753.1 | cccAcuuccccA ucuGcAudTsdT | 356 | A-94754.1 | AUGcAGAUGGGG AAGUGGGdTsdT | 584 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45098 | 255 | A-94190.1 | cAcuucccAucu uGcAuuudTsdT | 357 | A-94191.1 | AAAUGcAGAUGG GGAAGUGdTsdT | 585 |
| HAMP | AD-45400 | 256 | A-94755.1 | AcuucccAucu GcAuuudTsdT | 358 | A-94756.1 | AAAAUGcAGAUG GGGAAGUdTsdT | 586 |
| HAMP | AD-45381 | 257 | A-94757.1 | cuucccAucuG cAuuucdTsdT | 359 | A-94758.1 | GAAAAUGcAGAU GGGGAAGdTsdT | 587 |
| HAMP | AD-47069 | 258 | A-98386.1 | UfUfCfCfCfCf AUfCfUfGCfAU fUfUfUfCfUfd TsdT | 360 | A-98387.1 | AGAAAAUGCfAG AUGGGGAAdTsd T | 588 |
| HAMP | AD-45401 | 258 | A-94759.1 | uuccccAucuGc AuuuucdTsdT | 360 | A-94760.1 | AGAAAAUGcAGA UGGGGAAdTsdT | 588 |
| HAMP | AD-47075 | 261 | A-98388.1 | CfCfCfAUfCfU fGCfAUfUfUfU fCfUfGCfUfdT sdT | 361 | A-98389.1 | AGCfAGAAAAUG CfAGAUGGGdTs dT | 589 |
| HAMP | AD-29958 | 261 | A-66865.1 | cccAucuGcAuu uucuGcudTsdT | 361 | A-66866.1 | AGCAGAAAAUGc AGAUGGGdTsdT | 589 |
| HAMP | AD-45391 | 262 | A-94761.1 | ccAucuGcAuuu ucuGcGdTsdT | 362 | A-94762.1 | cAGcAGAAAAUG cAGAUGGdTsdT | 590 |
| HAMP | AD-29959 | 267 | A-66867.1 | uGcAuuuucuGc uGcGGcudTsdT | 363 | A-66868.1 | AGCCGcAGcAGA AAAUGcAdTsdT | 591 |
| HAMP | AD-29960 | 268 | A-66869.1 | GcAuuuucuGcu GcGGcuGdTsdT | 364 | A-66870.1 | cAGCCGcAGcAG AAAAUGcdTsdT | 592 |
| HAMP | AD-30019 | 270 | A-66871.1 | AuuuucuGcuGc GGcucudTsdT | 365 | A-66872.1 | AGcAGCCGcAGc AGAAAAUdTsdT | 593 |
| HAMP | AD-45396 | 271 | A-94763.1 | uuuucuGcuGcG GcuGcGdTsdT | 366 | A-94764.1 | cAGcAGCCGcAG cAGAAAdTsdT | 594 |
| HAMP | AD-45358 | 272 | A-94765.1 | uuucuGcuGcGG cuGcGudTsdT | 367 | A-94766.1 | AcAGcAGCCGcA GcAGAAAdTsdT | 595 |
| HAMP | AD-45364 | 273 | A-94767.1 | uucuGcuGcGGc uGcuGucdTsdT | 368 | A-94768.1 | GAcAGcAGCCGc AGcAGAAdTsdT | 596 |
| HAMP | AD-29962 | 274 | A-66873.1 | ucuGcuGcGGcu GcuGucAdTsdT | 369 | A-66874.1 | UGAcAGcAGCCG cAGcAGAdTsdT | 597 |
| HAMP | AD-47034 | 275 | A-98390.1 | CfUfGCfUfGCf GGCfUfGCfUfG UfCfAUfdTsdT | 370 | A-98391.1 | AUGACfFGCfAG CCGCfAGCfAGd TsdT | 598 |
| HAMP | AD-45370 | 275 | A-94769.1 | cuGcuGcGGcuG cuGucAudTsdT | 370 | A-94770.1 | AUGAcAGcAGCC GcAGcAGdTsdT | 598 |
| HAMP | AD-47046 | 276 | A-98394.1 | UfGCfUfGCfGG CfUfGCfUfGUf CfAUfUfdTsdT | 371 | A-98395.1 | AAUGACfAGCfA GCCGCfAGCfAd TsdT | 599 |
| HAMP | AD-47040 | 276 | A-98392.1 | UfGCfUfGCfGG CfUfGCfUfGUf CfAUfAdTsdT | 372 | A-98393.1 | CfAUGACfAGCf AGCCGCfAGCfA dTsdT | 600 |
| HAMP | AD-45728 | 276 | A-95730.1 | uGcuGcGGcuGc uGucAuudTsdT | 371 | A-95731.1 | AAUGAcAGcAGC CGcAGcAdTsdT | 599 |
| HAMP | AD-45722 | 276 | A-95728.1 | uGcuGcGGcuGc uGucAuAdTsdT | 372 | A-95729.1 | uAUGAcAGcAGC CGcAGcAdTsdT | 601 |
| HAMP | AD-29963 | 276 | A-66875.1 | uGcuGcGGcuGc uGucAucdTsdT | 373 | A-66876.1 | GAUGAcAGcAGC CGcAGcAdTsdT | 602 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45104 | 278 | A-94192.1 | cuGcGGcuGcuGucAucGAdTsdT | 374 | A-94193.1 | UCGAUGAcAGcAGCCGcAGdTsdT | 603 |
| HAMP | AD-47058 | 279 | A-98398.1 | UfGCfGGCfUfGCfUfGUfCfAUfCfGAUfdTsdT | 375 | A-98399.1 | AUCGAUGACfAGCfAGCCGCfAdTsdT | 604 |
| HAMP | AD-29964 | 279 | A-66877.1 | uGcGGcuGcuGucAucGAudTsdT | 375 | A-66878.1 | AUCGAUGAcAGcAGCCGcAdTsdT | 604 |
| HAMP | AD-47070 | 280 | A-98402.1 | GCfGGCfUfGCfUfGUfCfAUfCfGAUfUfdTsdT | 376 | A-98403.1 | AAUCGAUGACfAGCfAGCCGCdTsdT | 605 |
| HAMP | AD-47064 | 280 | A-98400.1 | GCfGGCfUfGCfUfGUfCfAUfCfGAUfFdTsdT | 377 | A-98401.1 | CfAUCGAUGACfAGCfAGCCGCdTsdT | 606 |
| HAMP | AD-45738 | 280 | A-95734.1 | GcGGcuGcuGucAucGAuudTsdT | 376 | A-95735.1 | AAUCGAUGAcAGcAGCCGCdTsdT | 605 |
| HAMP | AD-45733 | 280 | A-95732.1 | GcGGcuGcuGucAucGAuAdTsdT | 377 | A-95733.1 | uAUCGAUGAcAGcAGCCGCdTsdT | 607 |
| HAMP | AD-47076 | 281 | A-98404.1 | CfGGCfUfGCfUfGUfCfAUfCfGAUfCfAdTsdT | 378 | A-98405.1 | UGAUCGAUGACfAGCfAGCCGdTsdT | 608 |
| HAMP | AD-29965 | 281 | A-66879.1 | cGGcuGcuGucAucGAucAdTsdT | 378 | A-66880.1 | UGAUCGAUGAcAGcAGCCGdTsdT | 608 |
| HAMP | AD-47035 | 282 | A-98406.1 | GGCfUfGCfUfGUfCfAUfCfGAUfCfAAdTsdT | 379 | A-98407.1 | UUGAUCGAUGACfAGCfAGCCdTsdT | 609 |
| HAMP | AD-47041 | 283 | A-98408.1 | GCfUfGCfUfGUfCfAUfCfGAUfCfAAAdTsdT | 380 | A-98409.1 | UUUGAUCGAUGACfAGCfAGCdTsdT | 610 |
| HAMP | AD-30020 | 283 | A-18260.1 | GcuGcuGucAucGAucAAAdTsdT | 380 | A-18261.1 | UUUGAUCGAUGAcAGcAGCdTsdT | 610 |
| HAMP | AD-47053 | 284 | A-98412.1 | CfUfGCfUfGUfCfAUfCfGAUfCfAAAUfdTsdT | 381 | A-98413.1 | AUUUGAUCGAUGACfAGCfAGdTsdT | 611 |
| HAMP | AD-47047 | 284 | A-98410.1 | CfUfGCfUfGUfCfAUfCfGAUfCfAAAAdTsdT | 382 | A-98411.1 | UUUUGAUCGAUGACfAGCfAGdTsdT | 612 |
| HAMP | AD-45748 | 284 | A-95738.1 | cuGcuGucAucGAucAAAudTsdT | 381 | A-95739.1 | AUUUGAUCGAUGAcAGcAGdTsdT | 611 |
| HAMP | AD-45743 | 284 | A-95736.1 | cuGcuGucAucGAucAAAAdTsdT | 382 | A-95737.1 | UUUUGAUCGAUGAcAGcAGdTsdT | 612 |
| HAMP | AD-30021 | 284 | A-18284.1 | cuGcuGucAucGAucAAAGdTsdT | 383 | A-18285.1 | CUUUGAUCGAUGAcAGcAGdTsdT | 613 |
| HAMP | AD-47059 | 285 | A-98414.1 | UfGCfUfGUfCfAUfCfGAUfCfAAAGUfdTsdT | 384 | A-98415.1 | ACUUUGAUCGAUGACfAGCfAdTsdT | 614 |
| HAMP | AD-11441 | 285 | A-18278.3 | uGcuGucAucGAucAAAGudTsdT | 384 | A-18279.2 | ACUUUGAUCGAUGAcAGcAdTsdT | 614 |
| HAMP | AD-47071 | 286 | A-98418.1 | GCfUfGUfCfAUfCfGAUfCfAAAGUfUfdTsdT | 385 | A-98419.1 | AACUUUGAUCGAUGACfAGCdTsdT | 615 |
| HAMP | AD-47065 | 286 | A-98416.1 | GCfUfGUfCfAUfCfGAUfCfAAAGUfAdTsdT | 386 | A-98417.1 | CfACUUUGAUCGAUGACfAGCdTsdT | 616 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45758 | 286 | A-95742.1 | GcuGucAcuGAcuAAAGuudTsdT | 385 | A-95743.1 | AACUUUGAUCGAUGAcAGCdTsdT | 615 |
| HAMP | AD-45753 | 286 | A-95740.1 | GcuGucAucGAucAAAGuAdTsdT | 386 | A-95741.1 | uACUUUGAUCGAUGAcAGCdTsdT | 617 |
| HAMP | AD-29968 | 286 | A-18288.1 | GcuGucAucGAucAAAGuGdTsdT | 387 | A-18289.1 | cACUUUGAUCGAUGAcAGCdTsdT | 616 |
| HAMP | AD-47077 | 287 | A-98420.1 | CfUfGUfCfAUfCfGAUfCfAAAGUfGUfdTsdT | 388 | A-98421.1 | ACfACUUUGAUCGAUGACfAGdTsdT | 618 |
| HAMP | AD-29969 | 287 | A-18290.3 | cuGucAucGAucAAAgUgUdTsdT | 388 | A-18291.1 | AcACUUUGAUCGAUGAcAGdTsdT | 618 |
| HAMP | AD-48208 | 288 | A-100241.2 | uGucAucGAucAAAGuGuudTsdT | 389 | A-100243.1 | AACACUUUgAuCgAuGaCadTsdT | 619 |
| HAMP | AD-47042 | 288 | A-98424.1 | UfGUfCfAUfCfFAUfCfAAAGUfGUfUfdTsdT | 389 | A-98425.1 | AACfACUUUGAUCGAUGACfAdTsdT | 619 |
| HAMP | AD-48202 | 288 | A-100241.1 | uGucAcuGAucAAAGuGuudTsdT | 389 | A-100242.1 | AACACUuUGAuCGAuGacadTsdT | 619 |
| HAMP | AD-47036 | 288 | A-98422.1 | UfGUfCfAUfCfGAUfCfAAAGUfGUfAdTsdT | 390 | A-98423.1 | CfACfACUUUGAUCGAUGACfAdTsdT | 620 |
| HAMP | AD-45729 | 288 | A-95746.1 | uGucAucGAucAAAGuGuudTsdT | 389 | A-95747.1 | AAcACUUUGAUCGAUGAcAdTsdT | 619 |
| HAMP | AD-45723 | 288 | A-95744.1 | uGucAucGAucAAAGuGuAdTsdT | 390 | A-95745.1 | uAcACUUUGAUCGAUGAcAdTsdT | 621 |
| HAMP | AD-29970 | 288 | A-66881.1 | uGucAucGAucAAAGuGuGdTsdT | 391 | A-66882.1 | cACUUUGAUCGAUGAcAdTsdT | 620 |
| HAMP | AD-47048 | 290 | A-98426.1 | UfCfAUfCfGAUfCfAAAGUfGUfGGAdTsdT | 392 | A-98427.1 | UUCfACfACUUUGAUCGAUGAdTsdT | 622 |
| HAMP | AD-47054 | 290 | A-98428.1 | UfCfAUfCfGAUfCfAAAGUfGUfGGUfdTsdT | 393 | A-98429.1 | ACCfACfACUUUGAUCGAUGAdTsdT | 623 |
| HAMP | AD-45744 | 290 | A-95752.1 | ucAucGAucAAAGuGuGGudTsdT | 393 | A-95753.1 | ACcAcACUUUGAUCGAUGAdTsdT | 623 |
| HAMP | AD-45739 | 290 | A-95750.1 | ucAucGAucAAAGuGuGGAdTsdT | 392 | A-95751.1 | UCcAcACUUUGAUCGAUGAdTsdT | 622 |
| HAMP | AD-45734 | 290 | A-95748.1 | ucAucGAucAAAGuGuGGGdTsdT | 397 | A-95749.1 | CCcAcACUUUGAUCGAUGAdTsdT | 624 |
| HAMP | AD-47005 | 291 | A-98342.1 | CfAUfCfGAUfCfAAAGUfGUfGGGAdTsdT | 395 | A-98343.1 | UCCCfACfACUUUGAUCGAUGdTsdT | 625 |
| HAMP | AD-11436 | 291 | A-18268.1 | cAucGAucAAAGuGuGGGAdTsdT | 395 | A-18269.1 | UCCcAcACUUUGAUCGAUGdTsdT | 625 |
| HAMP | AD-11436 | 291 | A-18268.1 | cAucGAucAAAGuGuGGGAdTsdT | 395 | A-18269.1 | UCCcAcACUUUGAUCGAUGdTsdT | 625 |
| HAMP | AD-29971 | 291 | A-18268.1 | cAucGAucAAAGuGuGGGAdTsdT | 395 | A-18269.1 | UCCcAcACUUUGAUCGAUGdTsdT | 625 |
| HAMP | AD-45376 | 292 | A-94771.1 | AucGAucAAAGuGuGGGAudTsdT | 396 | A-94772.1 | AGAUCGAUUCCcAcACUUUdTsdT | 626 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45382 | 293 | A-94773.1 | ucGAucAAAGuG uGGGAuGdTsdT | 397 | A-94774.1 | cAUCCcAcACUU UGAUCGAdTsdT | 627 |
| HAMP | AD-29972 | 294 | A-66883.1 | cGAucAAAGuGu GGGAuGudTsdT | 398 | A-66884.1 | AcAUCCcAcACU UUGAUCGdTsdT | 628 |
| HAMP | AD-47066 | 295 | A-98432.1 | GAUfCfAAAGUf GUfGGGAUfFUf UfdTsdT | 399 | A-98433.1 | AACfAUCCCfAC fACUUUGAUdTs dT | 629 |
| HAMP | AD-47060 | 295 | A-98430.1 | GAUfCfAAAGUf GUfGGGAUfGUf AdTsdT | 400 | A-98431.1 | CfACfAUCCCfA CfACUUUGAUCd TsdT | 630 |
| HAMP | AD-45754 | 295 | A-95756.1 | GAucAAAGuGuG GGAuGuudTsdT | 399 | A-95757.1 | AAcUCCcAcAC UUUGAUCdTsdT | 629 |
| HAMP | AD-45749 | 295 | A-95754.1 | GAucAAAGuGuG GGAuGuAdTsdT | 400 | A-95755.1 | uAcAUCCcAcAC UUUGAUCdTsdT | 631 |
| HAMP | AD-29973 | 295 | A-66885.1 | GAucAAAGuGuG GGAuGudTsdT | 401 | A-66886.1 | cAcAUCCcAcAC UUUGAUCdTsdT | 630 |
| HAMP | AD-45730 | 296 | A-95762.1 | AucAAAGuGuGG GAuGuGudTsdT | 402 | A-95763.1 | AcAcAUCCcAcA CUUUGAUdTsdT | 632 |
| HAMP | AD-45724 | 296 | A-95760.1 | AucAAAGuGuGG GAuGuGAdTsdT | 403 | A-95761.1 | UcAcAUCCcAcA CUUUGAUdTsdT | 633 |
| HAMP | AD-45759 | 296 | A-95758.1 | AucAAAGuGuGG GAuGuGcdTsdT | 404 | A-95759.1 | GcAcAUCCcAcA CUUUGAUdTsdT | 634 |
| HAMP | AD-45110 | 297 | A-94194.1 | ucAAAGuGuGGG AuGuGcudTsdT | 405 | A-94195.1 | AGcAcAUCCcAc ACUUUGAdTsdT | 635 |
| HAMP | AD-45387 | 298 | A-94775.1 | cAAAGuGuGGGA uGuGcuGdTsdT | 406 | A-94776.1 | cAGcAcAUCCcA cACUUUGdTsdT | 636 |
| HAMP | AD-47072 | 299 | A-98434.1 | AAAGUfGUfGGG AUfGUfGCfUfG UfdTsdT | 407 | A-98435.1 | ACfAGCfACfAU CCCfACfACUUU dTsdT | 637 |
| HAMP | AD-45740 | 299 | A-95766.1 | AAAGuGuGGGAu GuGcuGAdTsdT | 408 | A-95767.1 | UcAGcAcAUCCc AcACUUUdTsdT | 638 |
| HAMP | AD-45745 | 299 | A-95768.1 | AAAGuGuGGGAu GuGcuGudTsdT | 407 | A-95769.1 | AcAGcAcAUCCc AcACUUUdTsdT | 637 |
| HAMP | AD-45735 | 299 | A-95764.1 | AAAGuGuGGGAu GuGcuGcdTsdT | 409 | A-95765.1 | GcAGcAcAUCCc dAcACUUUTsdT | 639 |
| HAMP | AD-29974 | 300 | A-66887.1 | AAGuGuGGGAuG uGcuGcAdTsdT | 410 | A-66888.1 | UGcAGcAcAUCC cAcACUUdTsdT | 640 |
| HAMP | AD-29975 | 301 | A-66889.1 | AGuGuGGGAuGu GcuGcAAdTsdT | 411 | A-66890.1 | UUGcAGcAcAUC CcAcACUdTsdT | 641 |
| HAMP | AD-45116 | 306 | A-94196.1 | GGGAuGuGcuGc AAGAcGudTsdT | 412 | A-94197.1 | ACGUCUUGcAGc AcAUCCCdTsdT | 642 |
| HAMP | AD-46988 | 307 | A-98258.1 | GGAUfGUfGCfU fGCfAAGACfGU fAdTsdT | 413 | A-98259.1 | CfACGUCUUGCf AGCfACfAUCCd TsdT | 643 |
| HAMP | AD-45075 | 307 | A-94198.1 | GGAuGuGcuGcA AGAcGuAdTsdT | 413 | A-94199.1 | uACGUCUUGcAG cAcAUCCdTsdT | 644 |
| HAMP | AD-46994 | 309 | A-98260.1 | AUfGUfGCfUfG CfAAGACfGUfA GAdTsdT | 414 | A-98261.1 | UCCfACGUCUUG CfAGCfACfAUd TsdT | 645 |
| HAMP | AD-45081 | 309 | A-94200.1 | AuGuGcuGcAAG AcGuAGAdTsdT | 414 | A-94201.1 | UCuACGUCUUGc AGcAcAUdTsdT | 646 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-47000 | 310 | A-98262.1 | UfGUfGCfUfGCfAAGACfGUfAGAAdTsdT | 415 | A-98263.1 | UUCCfACGUCUUGCfAGCfACfAdTsdT | 647 |
| HAMP | AD-45087 | 310 | A-94202.1 | uGuGcuGcAAGAcGuAGAAdTsdT | 415 | A-94203.1 | UUCuACGUCUUGcAGcAcAdTsdT | 648 |
| HAMP | AD-47006 | 313 | A-98264.1 | GCfUfGCfAAGACfGUfAGAACfCfUfdTsdT | 416 | A-98265.1 | AGGUUCCfACGUCUUGCfAGCdTsdT | 649 |
| HAMP | AD-45093 | 313 | A-94204.1 | GcuGcAAGAcGuAGAAccudTsdT | 416 | A-94205.1 | AGGUUCuACGUCUUGcAGCdTsdT | 650 |
| HAMP | AD-47011 | 314 | A-98266.1 | CfUfGCfAAGACfGUfAGAACfCfUfAdTsdT | 417 | A-98267.1 | CfAGGUUCCfACGUCUUGCfAGdTsdT | 651 |
| HAMP | AD-47016 | 322 | A-98268.1 | CfUfAGAACfCfUfACfCfUfGCfCfCfUfdTsdT | 418 | A-98269.1 | AGGGCfAAGCfAGGUUCCfACGdTsdT | 652 |
| HAMP | AD-45099 | 322 | A-94206.1 | cGuAGAAccuAccuGcccudTsdT | 418 | A-94207.1 | AGGGcAGGuAGGUUCuACGdTsdT | 653 |
| HAMP | AD-47021 | 347 | A-98270.1 | GUfCfCfCfCfUfCfCfCfUfUfCfCfCfUfUfAUfUfdTsdT | 419 | A-98271.1 | AACfAAGGAAGGGAGGGGACfGdTsdT | 654 |
| HAMP | AD-47026 | 348 | A-98272.1 | UfCfCfCfCfUfCfCfCfUfUfCfCfUfUfAUfUfdTsdT | 420 | A-98273.1 | AAACfAAGGAAGGGAGGGGAdTsdT | 655 |
| HAMP | AD-46989 | 349 | A-98274.1 | CfCfCfCfUfCfCfCfUfUfCfCfUfUfAUfUfUfAdTsdT | 421 | A-98275.1 | CfAAACfAAGGAAGGGAGGGGdTsdT | 656 |
| HAMP | AD-46995 | 350 | A-98276.1 | CfCfCfUfCfCfCfUfUfCfCfUfUfAUfUfUfAUfdTsdT | 422 | A-98277.1 | ACfAAACfAAGGAAGGGAGGGGdTsdT | 657 |
| HAMP | AD-47001 | 351 | A-98278.1 | CfCfUfCfCfCfUfUfCfCfUfUfAUfUfUfAUfUfUfdTsdT | 423 | A-98279.1 | AACfAAACfAAGGAAGGGAGGGdT | 658 |
| HAMP | AD-47012 | 352 | A-98282.1 | CfUfCfCfCfUfUfCfCfUfUfAUfUfUfAUfUfUfUfdTsdT | 424 | A-98283.1 | AAACfAAACfAAGGAAGGGAGGdT | 659 |
| HAMP | AD-47007 | 352 | A-98280.1 | CfUfCfCfCfUfUfCfCfUfUfAUfUfUfAUfUfUfAdTsdT | 425 | A-98281.1 | CfAACfAAACfAAGGAAGGGAGdTsdT | 660 |
| HAMP | AD-47017 | 354 | A-98284.1 | CfCfCfUfUfCfCfUfUfUfAUfUfUfAUfUfCfCfUfdTsdT | 426 | A-98285.1 | AGGAACfAAACfAAGGAAGGGdT | 661 |
| HAMP | AD-47022 | 355 | A-98286.1 | CfCfUfUfCfCfUfUfAUfUfUfAUfUfCfCfUfAdTsdT | 427 | A-98287.1 | CfAGGAACfAAACfAAGGAAGGdTsdT | 662 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-47027 | 355 | A-98288.1 | CfCfUfUfCfCf UfUfAUfUfUfA UfUfCfCfUfUf dTsdT | 428 | A-98289.1 | AAGGAACfAAAC fAAGGAAGGdTs dT | 663 |
| HAMP | AD-46996 | 356 | A-98292.1 | CfUfUfCfCfUf UfAUfUfUfAUf UfCfCfUfGUfd TsdT | 429 | A-98293.1 | ACfAGGAACfAA ACfAAGGAAGdT sdT | 664 |
| HAMP | AD-46990 | 356 | A-98290.1 | CfUfUfCfCfUf UfAUfUfUfAUf UfCfCfUfGAdT sdT | 430 | A-98291.1 | UCfAGGAACfAA ACfAAGGAAGdT sdT | 665 |
| HAMP | AD-47002 | 357 | A-98294.1 | UfUfCfCfUfUf AUfUfUfAUfUf CfCfUfGCfUfd TsdT | 431 | A-98295.1 | AGCfAGGAACfA AACfAAGGAAdT sdT | 666 |
| HAMP | AD-47013 | 358 | A-98298.1 | UfCfCfUfUfAU fUfUfAUfUfCf CfUfGCfUfUfd TsdT | 432 | A-98299.1 | AAGCfAGGAACf AAACfAAGGAdT sdT | 667 |
| HAMP | AD-47008 | 358 | A-98296.1 | UfCfCfUfUfAU fUfUfAUfUfCf CfUfGCfUfAdT sdT | 433 | A-98297.1 | CfAGCfAGGAAC fAAACfAAGGAd TsdT | 668 |
| HAMP | AD-47023 | 359 | A-98302.1 | CfCfUfUfAUfU fUfAUfUfCfCf UfGCfUfGUfdT sdT | 434 | A-98303.1 | ACfAGCfAGGAA CfAAACfAAGGd TsdT | 669 |
| HAMP | AD-47018 | 359 | A-98300.1 | CfCfUfUfAUfU fUfAUfUUCfCf UfGCfUfGAdTs dT | 435 | A-98301.1 | UCfAGCfAGGAA CfAAACfAAGGd TsdT | 670 |
| HAMP | AD-47028 | 363 | A-98304.1 | AUfUfUfAUfUf CfCfCfGCfUfG CfCfCfCfAdTs dT | 436 | A-98305.1 | UGGGGCfAGCfA GGAACfAAAUdT sdT | 671 |
| HAMP | AD-46991 | 365 | A-98306.1 | UfUfAUfUfCfC fUfGCfUfGCfC fCfCfAGAdTsd T | 437 | A-98307.1 | UCUGGGGCfAGC fAGGAACfAAdT sdT | 672 |
| HAMP | AD-46997 | 366 | A-98308.1 | UfAUfUfCfCfU fGCfUfGCfCfC fCfAGAAdTsdT | 438 | A-98309.1 | UUCUGGGGCfAG CfAGGAACfAdT sdT | 673 |
| HAMP | AD-47003 | 369 | A-98310.1 | UfCfCfUfGCfU fGCfCfCfCfAG AACfAUfdTsdT | 439 | A-98311.1 | AUGUUCUGGGGC fAGCfAGGAdTs dT | 674 |
| HAMP | AD-45105 | 369 | A-94208.1 | uccuGcuGcccc AGAAcAudTsdT | 439 | A-94209.1 | AUGUUCUGGGGc AGcAGGAdTsdT | 674 |
| HAMP | AD-47009 | 370 | A-98312.1 | CfCfUfGCfUfG CfCfCfCfAGAA CfAUfAdTsdT | 440 | A-98313.1 | CfAUGUUCUGGG GCfAGCfAGGdT sdT | 675 |
| HAMP | AD-45111 | 370 | A-94210.1 | ccuGcuGccccA GAAcAuAdTsdT | 440 | A-94211.1 | uAUGUUCUGGGG cAGcAGGAdTsdT | 676 |
| HAMP | AD-47014 | 373 | A-98314.1 | GCfUfGCfCfCf CfAGAACfAUfA GGUfdTsdT | 441 | A-98315.1 | ACCCfAUGUUCU GGGGCfAGCdTs dT | 677 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-45117 | 373 | A-94212.1 | GcuGccccAGAAcAuAGGudTsdT | 441 | A-94213.1 | ACCuAUGUUCUGGGGcAGCdTsdT | 678 |
| HAMP | AD-47019 | 375 | A-98316.1 | UfGCfCfCfCfAGAACfAUfAGGUfCfUfdTsdT | 442 | A-98317.1 | AGACCCfAUGUUCUGGGGCfAdTsdT | 679 |
| HAMP | AD-45076 | 375 | A-94214.1 | uGccccAGAAcAuAGGucudTsdT | 442 | A-94215.1 | AGACCuAUGUUCUGGGGcAdTsdT | 680 |
| HAMP | AD-48214 | 376 | A-100244.1 | GccccAGAAcAuAGGucuudTdT | 443 | A-100245.1 | AAGACCuAUGUUCUGGGGCdTdT | 681 |
| HAMP | AD-48219 | 376 | A-100246.1 | GcCCCAGAAcAuAGGucuudTdT | 443 | A-100247.1 | AAGACCuaUGuuCUGGGGcdTdT | 681 |
| HAMP | AD-47024 | 376 | A-98318.1 | GCfCfCfCfAGAACfAUfAGGUfCfUfUfdTsdT | 443 | A-98319.1 | AAGACCCfAUGUCUGGGGCdTsdT | 682 |
| HAMP | AD-45082 | 376 | A-94216.1 | GccccAGAAcAuAGGucuudTsdT | 443 | A-94217.1 | AAGACCuAUGUUCUGGGGCdTsdT | 681 |
| HAMP | AD-48224 | 379 | A-100248.1 | ccAGAAcAuAGGucuuGGAdTdT | 444 | A-100249.1 | UCcAAGACCuAUGUUCUCGdTdT | 683 |
| HAMP | AD-48187 | 379 | A-100248.2 | ccAGAAcAuAGGucuuGGAdTdT | 444 | A-100250.1 | uCCAAGACCuAUGuUCuggdTdT | 684 |
| HAMP | AD-47029 | 379 | A-98320.1 | CfCfAGAACfAUfAGGUfCfUfUfGGAdTsdT | 444 | A-98321.1 | UCCfAAGACCCfAUGUUCUGGdTsdT | 685 |
| HAMP | AD-48192 | 379 | A-100248.3 | ccAGAAcAuAGGucuuGGAdTdT | 444 | A-100251.1 | uCCAAGACCUaUgUuCuGgdTdT | 684 |
| HAMP | AD-45088 | 379 | A-94218.1 | ccAGAAcAuAGGucuuGGAdTsdT | 444 | A-94219.1 | UCcAAGACCuAUGUUCUGGdTsdT | 684 |
| HAMP | AD-46992 | 380 | A-98322.1 | CfAGAACfAUfAGGUfCfUfUfGGAAdTsdT | 445 | A-98323.1 | UUCCfAAGACCfAUGUUCUGdTsdT | 686 |
| HAMP | AD-45094 | 380 | A-94220.1 | cAGAAcAuAGGucuuGGAAdTsdT | 445 | A-94221.1 | UUcAAGACCuAUGUUCUGdTsdT | 687 |
| HAMP | AD-46998 | 381 | A-98324.1 | AGAACfAUfAGGUfCfUfUfGGAAUfdTsdT | 446 | A-98325.1 | AUUCCfAAGACCCfAUGUUCUdTsdT | 688 |
| HAMP | AD-45100 | 381 | A-94222.1 | AGAAcAuAGGucuuGGAAudTsdT | 446 | A-94223.1 | AUUCcAAGACCuAUGUUCUdTsdT | 689 |
| HAMP | AD-48137 | 382 | A-100195.1 | GAAcAuAGGUCUUGGAAUAdTdT | 30 | A-98136.7 | UAUUCCAAGACCUAUGUUCdTdT | 44 |
| HAMP | AD-48196 | 382 | A-100179.22 | GAAcAuAGGucuuGGAAuAdTdT | 30 | A-100228.1 | UAuUCCAAGaCCuAuGuucdTdT | 44 |
| HAMP | AD-48195 | 382 | A-98135.8 | GAACAUAGGUCUUGGAAUAdTdT | 30 | A-100218.1 | UAUUCCaAgAcCuAuGuUcdTdT | 44 |
| HAMP | AD-48201 | 382 | A-100179.23 | GAAcAuAGGucuuGGAAuAdTdT | 30 | A-100229.1 | UAUUCCAAGaCCuAuGuucdTdT | 44 |
| HAMP | AD-48207 | 382 | A-100179.24 | GAAcAuAGGucuuGGAAuAdTdT | 30 | A-100230.1 | UAUUCCAAGaCCuAuGuucdTdT | 44 |
| HAMP | AD-48159 | 382 | A-100179.5 | GAAcAuAGGucuuGGAAuAdTdT | 30 | A-100184.1 | UAUUCCAAGACCuAUGuUCdTdT | 44 |
| HAMP | AD-48147 | 382 | A-100179.3 | GAAcAuAGGucuuGGAAuAdTdT | 30 | A-100182.1 | UAUUCcAAGACCuAuGuUCdTdT | 44 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-48161 | 382 | A-98135.4 | GAACAUAGGUCUUGGAAUAdTdT | 30 | A-100188.2 | UAUUCCAAGACCUAuGuUcdTdT | 44 |
| HAMP | AD-48172 | 382 | A-100193.1 | GAAcAuAGGucUUGGAAUAdTdT | 30 | A-98136.5 | UAUUCCAAGACCUAUGUUCdTdT | 44 |
| HAMP | AD-48156 | 382 | A-100194.4 | GAAcAuAGGuCUUGGAAUAdTdT | 30 | A-100188.3 | UAUUCCAAGACCUAuGuUcdTdT | 44 |
| HAMP | AD-48195 | 382 | A-98135.8 | GAACAUAGGUCUUGGAAUAdTdT | 30 | A-100218.1 | UAUUcCaAgAcCuAuGuUcdTdT | 44 |
| HAMP | AD-48136 | 382 | A-100179.9 | GAAcAuAGGucuuGGAAUAdTdT | 30 | A-100187.1 | UAUUCCAAGACCUAUGuUcdTdT | 44 |
| HAMP | AD-48166 | 382 | A-100192.1 | GAAcAuAGGucuUGGAAUAdTdT | 30 | A-98136.1 | UAUUCCAAGACCUAUGUUCdTdT | 44 |
| HAMP | AD-48213 | 382 | A-100179.25 | GAAcAuAGGucuuGGAAuAdTdT | 30 | A-100231.1 | UAuUCCAAgAcCuAuGuucdTdT | 44 |
| HAMP | AD-48173 | 382 | A-98135.6 | GAACAUAGGUCUUGGAAUAdTdT | 30 | A-100190.2 | UAUUCCAAGACcuAuGuUcdTdT | 44 |
| HAMP | AD-48154 | 382 | A-100179.12 | GAAcAuAGGucuuGGAAUAdTdT | 30 | A-100190.1 | UAUUCCAAGACcuAuGuUcdTdT | 44 |
| HAMP | AD-48141 | 382 | A-100179.2 | GAAcAuAGGuCUUGGAAUAdTdT | 30 | A-100181.1 | UAuUCcAAGACCuAuGuUCdTdT | 44 |
| HAMP | AD-48216 | 382 | A-100217.3 | GAAcAuAGGuCUUGGAAUAdTsdT | 30 | A-100215.3 | UAUUCCAAGACcuAuGuUcdTsdT | 44 |
| HAMP | AD-48180 | 382 | A-100194.8 | GAAcAuAGGuCUUGGAAUAdTdT | 30 | A-100183.2 | UAUUCCAAGACCuAuGuUCdTdT | 44 |
| HAMP | AD-48143 | 382 | A-100196.1 | GAAcAuAGGUCUUGGAAUAdTdT | 30 | A-98136.8 | UAUUCCAAGACCUAUGUUCdTdT | 44 |
| HAMP | AD-48142 | 382 | A-100179.10 | GAAcAuAGGucuduGGAAuATdT | 30 | A-100188.1 | UAUUCCAAGACCUAuGuUcdTdT | 44 |
| HAMP | AD-48221 | 382 | A-18280.13 | GAAcAuAGGucuuGGAAuAdTsdT | 30 | A-15168.3 | UAUUCCAAGACCUAUGUUCdTsdT | 44 |
| HAMP | AD-48171 | 382 | A-100179.7 | GAAcAUAGGucuuGGAAuAdTdT | 30 | A-98136.2 | UAUUCCAAGACCUAUGUUCdTdT | 44 |
| HAMP | AD-48145 | 382 | A-100195.4 | GAAcAuAGGUCUUGGAAUAdTdT | 30 | A-100183.3 | UAUUCCAAGACCuAuGuUCdTdT | 44 |
| HAMP | AD-48160 | 382 | A-100191.1 | GAAcAuAGGucuuGGAAUAdTdT | 30 | A-98136.3 | UAUUCCAAGACCUAUGUUCdTdT | 44 |
| HAMP | AD-48144 | 382 | A-100194.2 | GAAcAuAGGuCUUGGAAUAdTdT | 30 | A-100190.5 | UAUUCCAAGACcuAuGuUcdTdT | 44 |
| HAMP | AD-48167 | 382 | A-98135.5 | GAACAUAGGUCUUGGAAUAdTdT | 30 | A-100189.2 | UAUUCCAAGACCuAuGuUcdTdT | 44 |
| HAMP | AD-48177 | 382 | A-100179.8 | GAAcAuAGGucuuGGAAUAdTdT | 30 | A-100186.1 | UAUUCCAAGACCUAUGuUCdTdT | 44 |
| HAMP | AD-48153 | 382 | A-100179.4 | GAAcAuAGGucuuGGAAUAdTdT | 30 | A-100183.1 | UAUUCCAAGACCuAuGuUCdTdT | 44 |
| HAMP | AD-48178 | 382 | A-100194.1 | GAAcAuAGGuCUUGGAAUAdTdT | 30 | A-98136.6 | UAUUCCAAGACCUAUGUUCdTdT | 44 |
| HAMP | AD-48155 | 382 | A-98135.3 | GAACAUAGGUCUUGGAAUAdTdT | 30 | A-100187.2 | UAUUCCAAGACCUAUGuUcdTdT | 44 |

TABLE 4-continued

HAMP modified sequences

| Target | Duplex ID | Start Position | Sense Name | Sense Sequence | Antisense Name | Antisense Sequence | SEQ ID NO |
|---|---|---|---|---|---|---|---|
| HAMP | AD-48174 | 382 | A-100194.7 | GAAcAuAGGuCU UGGAAUAdTdT | A-100197.1 | UAUUCCAAGACc uAuGuUCdTdT | 44 |
| HAMP | AD-48205 | 382 | A-15167.2 | GAACAUAGGUCU UGGAAUAdTsdT | A-100215.2 | UAUUCCAAGACc uAuGuUcdTsdT | 44 |
| HAMP | AD-48179 | 382 | A-100196.2 | GAACAUAGGUCU UGGAAUAdTdT | A-100190.3 | UAUUCCAAGACc uAuGuUcdTdT | 44 |
| HAMP | AD-48168 | 382 | A-100194.6 | GAAcAuAGGuCU UGGAAUAdTdT | A-100186.3 | UAUUCCAAGACC UAUGUUcdTdT | 44 |
| HAMP | AD-48149 | 382 | A-98135.2 | GAACAUAGGUCU UGGAAUAdTdT | A-100186.2 | UAUUCCAAGACC UAUGUUcdTdT | 44 |
| HAMP | AD-48211 | 382 | A-100217.2 | GAAcAuAGGuCU UGGAAUAdTsdT | A-100214.2 | UAUUCCAAGACC uAuGuUCdTsdT | 44 |
| HAMP | AD-48200 | 382 | A-100217.1 | GAAcAuAGGuCU UGGAAUAdTsdT | A-15168.2 | UAUUCCAAGACC UAUGUUCdTsdT | 44 |
| HAMP | AD-48188 | 382 | A-100179.20 | GAAcAuAGGucu uGGAAuAdTdT | A-100205.1 | UAuUCcAAGACC uAuGuUcdTdT | 44 |
| HAMP | AD-48183 | 382 | A-18280.10 | GAAcAuAGGucu uGGAAuAdTdT | A-100214.1 | UAUUCCAAGACC uAuGuUcdTdT | 44 |
| HAMP | AD-48150 | 382 | A-100194.3 | GAAcAuAGGuCU UGGAAUAdTdT | A-100189.3 | UAUUCCAAGACC uAuGuUcdTdT | 44 |
| HAMP | AD-48162 | 382 | A-100194.5 | GAAcAuAGGuCU UGGAAUAdTdT | A-100187.3 | UAUUCCAAGACC UAUGuUcdTdT | 44 |
| HAMP | AD-48139 | 382 | A-100195.3 | GAAcAuAGGUCU UGGAAUAdTdT | A-100197.2 | UAUUCCAAGACc uAuGuUCdTdT | 44 |
| HAMP | AD-9940 | 382 | A-15167.1 | GAACAUAGGUCU UGGAAUAdTsdT | A-15168.2 | UAUUCCAAGACC UAUGUUCdTsdT | 44 |
| HAMP | AD-48138 | 382 | A-100195.2 | GAAcAuAGGUCU UGGAAUAdTdT | A-100190.4 | UAUUCCAAGACc uAuGuUcdTdT | 44 |
| HAMP | AD-11459 | 382 | A-18280.2 | GAAcAuAGGucu uGGAAuAdTsdT | A-18304.1 | uAuUCcAAGACC uAuGuUCdTsdT | 44 |
| HAMP | AD-48189 | 382 | A-18280.11 | GAAcAuAGGucu uGGAAuAdTdT | A-100215.1 | UAUUCCAAGACc uAuGuUcdTdT | 44 |
| HAMP | AD-48148 | 382 | A-100179.11 | GAAcAuAGGucu uGGAAuAdTdT | A-100189.1 | UAUUCCAAGACC uAuGuUcdTdT | 44 |
| HAMP | AD-48215 | 382 | A-18280.8 | GAAcAuAGGucu uGGAAuAdTsdT | A-100212.1 | UAuUCcAAGACC uAuGuUCdTsdT | 44 |
| HAMP | AD-48218 | 382 | A-100179.26 | GAAcAuAGGucu uGGAAuAdTdT | A-100232.1 | uAuUCCAAgAcC uAuGuucdTdT | 44 |
| HAMP | AD-48135 | 382 | A-100179.1 | GAAcAuAGGucu uGGAAuAdTdT | A-100180.1 | uAuUCcAAGACC uAuGuUcdTdT | 44 |
| HAMP | AD-47004 | 382 | A-98326.1 | GAACfAUfAGGU fCfUfUfGGAAU fAdTsdT | A-98327.1 | CfAUUCCfAAGA CCCfAUGUUCdT sdT | 690 |
| HAMP | AD-48194 | 382 | A-18280.12 | GAAcAuAGGucu uGGAAuAdTsdT | A-100216.1 | uAUUCCAAGACC uAuGuUcdTsdT | 44 |
| HAMP | AD-48197 | 382 | A-100239.1 | GAAcAuAGGuCd TUdGGdAAdTAd TdT | A-100240.1 | dTAdTUdCCdAA dGACCuAuGuuc dTdT | 691 |
| HAMP | AD-11459 | 382 | A-18280.2 | GAAcAuAGGucu uGGAAuAdTsdT | A-18304.1 | uAuUCcAAGACC uAuGuUCdTsdT | 44 |

TABLE 4-continued

HAMP modified sequences

| Target | Duplex ID | Start Position | Sense Name | Sense Sequence | Antisense Name | Antisense Sequence | SEQ ID NO |
|---|---|---|---|---|---|---|---|
| HAMP | AD-48164 | 382 | A-100179.16 | GAAcAuAGGucuuGGAAuAdTdT | A-100201.1 | uAUUCcAAGACCuAuGuUCdTdT | 44 |
| HAMP | AD-48158 | 382 | A-100179.15 | GAAcAuAGGucuuGGAAuAdTdT | A-100200.1 | uAUUCCAAGACCuAuGuUCdTdT | 44 |
| HAMP | AD-48204 | 382 | A-100208.1 | GAAcAcAGGucuuGGAAuAdTdT | A-100209.1 | uAUCcAAGACCuGuGuUCdTdT | 692 |
| HAMP | AD-48181 | 382 | A-100192.2 | GAAcAuAGGucuUGGAAUAdTdT | A-100180.7 | uAUCcAAGACCuAuGuUCdTdT | 44 |
| HAMP | AD-48223 | 382 | A-100233.1 | GAAcAuAGGucuuGGAAuAuu | A-100234.1 | uAUCcAAGACCuAuGuUCuu | 706 |
| HAMP | AD-48190 | 382 | A-100179.21 | GAAcAuAGGucuuGGAAuAdTdT | A-100227.1 | uAUCCAAGaCCuAuGuucdTdT | 44 |
| HAMP | AD-48163 | 382 | A-100195.5 | GAAcAuAGGUCUUGGAAUAdTdT | A-100180.4 | uAUCcAAGACCuAuGuUCdTdT | 44 |
| HAMP | AD-48140 | 382 | A-100191.2 | GAAcAuAGGucuuGGAAUAdTdT | A-100180.8 | uAUCcAAGACCuAuGuUCdTdT | 44 |
| HAMP | AD-48169 | 382 | A-100194.9 | GAAcAuAGGuCUUGGAAUAdTdT | A-100180.5 | uAUCcAAGACCuAuGuUCdTdT | 44 |
| HAMP | AD-48220 | 382 | A-18280.9 | GAAcAuAGGucuuGGAAuAdTsdT | A-100213.1 | uAUCcAAGACCuAuGuUcdTsdT | 44 |
| HAMP | AD-48184 | 382 | A-15167.3 | GAACAUAGGUCUUGGAAUAdTsdT | A-18304.6 | uAUCcAAGACCuAuGuUCdTsdT | 44 |
| HAMP | AD-48176 | 382 | A-100179.18 | GAAcAuAGGucuuGGAAuAdTdT | A-100203.1 | uAUUCCAAGACCuAuGuUcdTdT | 44 |
| HAMP | AD-48175 | 382 | A-100193.2 | GAAcAuAGGucUUGGAAUAdTdT | A-100180.6 | uAUCcAAGACCuAuGuUCdTdT | 44 |
| HAMP | AD-48146 | 382 | A-100179.13 | GAAcAuAGGucuuGGAAuAdTdT | A-100198.1 | uAUUCCAAGACCUAUGUUCdTdT | 44 |
| HAMP | AD-48182 | 382 | A-100179.19 | GAAcAuAGGucuuGGAAuAdTdT | A-100204.1 | uAUCcAAGACCuAuGuUCdTdT | 44 |
| HAMP | AD-48199 | 382 | A-100207.1 | GAAcAuAGGUCUUGGAAuAdTdT | A-100180.10 | uAUCcAAGACCuAuGuUCdTdT | 44 |
| HAMP | AD-48157 | 382 | A-100196.3 | GAAcAUAGGUCUUGGAAUAdTdT | A-100180.3 | uAUCcAGACCuAuGuUCdTdT | 44 |
| HAMP | AD-48206 | 382 | A-100219.1 | GAAcAcAGGucuuGGAAuAdTsdT | A-100220.1 | uAUCcAAGACCuGuGuUCdTsdT | 692 |
| HAMP | AD-48193 | 382 | A-100206.1 | GAAcAuAGGuCuuGGAAuAdTdT | A-100180.9 | uAUCcAAGACCuAuGuUCdTdT | 44 |
| HAMP | AD-48152 | 382 | A-100179.14 | GAAcAuAGGucuuGGAAuAdTdT | A-100199.1 | uAUUCCAAGACCUAUGUUCdTdT | 44 |
| HAMP | AD-48151 | 382 | A-98135.7 | GAACAUAGGUCUUGGAAUAdTdT | A-100180.2 | uAUCcAAGACCuAuGuUCdTdT | 44 |
| HAMP | AD-48170 | 382 | A-100179.17 | GAAcAuAGGucuuGGAAuAdTdT | A-100202.1 | uAUCUAAGACCuAuGuUCdTdT | 693 |
| HAMP | AD-47010 | 383 | A-98328.1 | AACfAUfAGGUfCfUfUfGGAAUfAAdTdT | A-98329.1 | UCfAUUCCfAAGACCCfAUGUUdTdT | 694 |
| HAMP | AD-45106 | 383 | A-94224.1 | AAcAuAGGucuuGGAAuAAdTsdT | A-94225.1 | UuAUUCcAAGACCuAUGuUdTsdT | 695 |

TABLE 4-continued

HAMP modified sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HAMP | AD-48222 | 385 | A-100224.1 | AAcAuAGGucuuGGAAuAAdTsdT | 451 | A-100225.1 | UuAUUCcAAGACCuAuGUUdTsdT | 696 |
| HAMP | AD-48217 | 385 | A-100221.2 | cAuAGGucuuGGAAuAAAAdTdT | 451 | A-100223.1 | UUUuAUUCcAAGACCuAUdTdT | 696 |
| HAMP | AD-48185 | 385 | A-100221.3 | cAuAGGucuuGGAAuAAAAdTdT | 451 | A-100226.1 | uUUUAuuCCaaGACCUaugdTdT | 696 |
| HAMP | AD-48212 | 385 | A-100221.1 | cAuAGGucuuGGAAuAAAAdTdT | 451 | A-100222.1 | UuUuAuUCcAAGACCuAuGdTdT | 696 |
| HAMP | AD-48198 | 396 | A-100252.1 | GAAuAAAAuGGcuGGuucudTdT | 452 | A-100253.1 | AGAACcAGCcAUUUuAUUCdTdT | 697 |
| HAMP | AD-48209 | 396 | A-100252.3 | GAAuAAAAuGGcuGGuucudTdT | 452 | A-100255.1 | AGAACCAGcCaUuUuAuUcdTdT | 697 |
| HAMP | AD-48203 | 396 | A-100252.2 | GAAuAAAAuGGcuGGuucudTdT | 452 | A-100254.1 | AGAACcAGCCAuuUUAuucdTdT | 697 |
| HAMP | AD-47015 | 396 | A-98330.1 | GAAUfAAAAUfGGCfUfGGUfUfCfUfdTsdT | 452 | A-98331.1 | AGAACCfAGCCfAUUUCfAUUCdTsdT | 698 |
| HAMP | AD-45112 | 396 | A-94226.1 | GAAuAAAAuGGcuGGuucudTsdT | 452 | A-94227.1 | AGAACcAGCcAUUUuAUUCdTsdT | 697 |
| HAMP | AD-47020 | 398 | A-98332.1 | AUfAAAAUfGGCfUfGGUfUfCfUfUfUfdTsdT | 453 | A-98333.1 | AAAGAACCfAGCCfAUUUCfAUdTsdT | 699 |
| HAMP | AD-45118 | 398 | A-94228.1 | AuAAAAuGGcuGGuucuuudTsdT | 453 | A-94229.1 | AAAGAACcAGCcAUUUuAUdTsdT | 700 |
| HAMP | AD-47025 | 399 | A-98334.1 | UfAAAAUfGGCfUfGGUfUfCfUfUfUfUfdTsdT | 454 | A-98335.1 | AAAAGAACCfAGCCfAUUUCfAUdTsdT | 701 |
| HAMP | AD-45077 | 399 | A-94230.1 | uAAAAuGGcuGGuucuuuudTsdT | 454 | A-94231.1 | AAAAGAACcAGCcAUUUuAdTsdT | 702 |
| HAMP | AD-47030 | 402 | A-98336.1 | AAUfGGCfUfGGUfUfCfUfUfUfUfUfGUfUfdTsdT | 455 | A-98337.1 | AACfAAAAGAACCfAGCCfAUUdTsdT | 703 |
| HAMP | AD-45083 | 402 | A-94232.1 | AAuGGcuGGuucuuuuGuudTsdT | 455 | A-94233.1 | AAcAAAAGAACcAGCcAUUdTsdT | 703 |
| HAMP | AD-46993 | 403 | A-98338.1 | AUfGGCfUfGGUfUfCfUfUfUfUfUfGUfUfUfdTsdT | 456 | A-98339.1 | AAACfAAAAGAACCfAGCCfAUdTsdT | 704 |
| HAMP | AD-45089 | 403 | A-94234.1 | AuGGcuGGuucuuuuGuuudTsdT | 456 | A-94235.1 | AAAcAAAAGAACcAGCcAUdTsdT | 704 |
| HAMP | AD-46999 | 407 | A-98340.1 | CfUfGGUfUfCfUfUfUfUfUfGUfUfUfUfCfCfAdTsdT | 457 | A-98341.1 | UGGAAAACfAAAAGAACCfAGdTsdT | 705 |

It should be noted that unmodified versions of each of the modified sequences shown are included within the scope of the invention.

TABLE 5

HAMP unmodified seqeunces

| Target | Duplex ID | Start Position | Antisense Name | Antisense Sequence | SEQ ID NO | Sense Name | Sense Sequence | SEQ ID NO |
|---|---|---|---|---|---|---|---|---|
| HAMP | AD-47121 | 62 | A-98153.1 | AGACGGCACGAUGGCACUUdTdT | 250 | A-98154.1 | AAGUGCCAUCGUGCCGUCUdTdT | 475 |
| HAMP | AD-47133 | 67 | A-98157.1 | GCACGAUGGCACUGAGCUUdTdT | 258 | A-98158.1 | AAGCUCAGUGCCAUCGUGCdTdT | 483 |
| HAMP | AD-47127 | 67 | A-98155.1 | GCACGAUGGCACUGAGCUAdTdT | 259 | A-98156.1 | UAGCUCAGUGCCAUCGUGCdTdT | 486 |
| HAMP | AD-47145 | 74 | A-98161.1 | GGCACUGAGCUCCCAGAUUdTdT | 271 | A-98162.1 | AAUCUGGGAGCUCAGUGCCdTdT | 497 |
| HAMP | AD-47139 | 74 | A-98159.1 | GGCACUGAGCUCCCAGAUAdTdT | 272 | A-98160.1 | UAUCUGGGAGCUCAGUGCCdTdT | 500 |
| HAMP | AD-47157 | 76 | A-98165.1 | CACUGAGCUCCCAGAUCUUdTdT | 275 | A-98166.1 | AAGAUCUGGGAGCUCAGUGdTdT | 502 |
| HAMP | AD-47151 | 76 | A-98163.1 | CACUGAGCUCCCAGAUCUAdTdT | 276 | A-98164.1 | UAGAUCUGGGAGCUCAGUGdTdT | 504 |
| HAMP | AD-47163 | 132 | A-98167.1 | CUGACCAGUGGCUCUGUUUdTdT | 288 | A-98168.1 | AAACAGAGCCACUGGUCAGdTdT | 515 |
| HAMP | AD-47122 | 140 | A-98169.1 | UGGCUCUGUUUUCCCACAAdTdT | 289 | A-98170.1 | UUGUGGGAAAACAGAGCCAdTdT | 516 |
| HAMP | AD-47128 | 146 | A-98171.1 | UGUUUUCCCACAACAGACAdTdT | 291 | A-98172.1 | UGUCUGUUGUGGGAAAACAdTdT | 518 |
| HAMP | AD-47134 | 146 | A-98173.1 | UGUUUUCCCACAACAGACUdTdT | 292 | A-98174.1 | AGUCUGUUGUGGGAAAACAdTdT | 519 |
| HAMP | AD-47140 | 155 | A-98175.1 | ACAACAGACGGGACAACUUdTdT | 302 | A-98176.1 | AAGUUGUCCCGUCUGUUGUdTdT | 529 |
| HAMP | AD-47152 | 157 | A-98179.1 | AACAGACGGGACAACUUGUdTdT | 303 | A-98180.1 | ACAAGUUGUCCCGUCUGUUdTdT | 530 |
| HAMP | AD-47146 | 157 | A-98177.1 | AACAGACGGGACAACUUGAdTdT | 304 | A-98178.1 | UCAAGUUGUCCCGUCUGUUdTdT | 531 |
| HAMP | AD-47158 | 160 | A-98181.1 | AGACGGGACAACUUGCAGAdTdT | 307 | A-98182.1 | UCUGCAAGUUGUCCCGUCUdTdT | 534 |
| HAMP | AD-47164 | 161 | A-98183.1 | GACGGGACAACUUGCAGAAdTdT | 309 | A-98184.1 | UUCUGCAAGUUGUCCCGUCdTdT | 536 |
| HAMP | AD-47123 | 161 | A-98185.1 | GACGGGACAACUUGCAGAUdTdT | 308 | A-98186.1 | AUCUGCAAGUUGUCCCGUCdTdT | 535 |
| HAMP | AD-47135 | 162 | A-98189.1 | ACGGGACAACUUGCAGAGUdTdT | 312 | A-98190.1 | ACUCUGCAAGUUGUCCCGUdTdT | 539 |
| HAMP | AD-47129 | 162 | A-98187.1 | ACGGGACAACUUGCAGAGAdTdT | 311 | A-98188.1 | UCUCUGCAAGUUGUCCCGUdTdT | 538 |
| HAMP | AD-47141 | 242 | A-98191.1 | GAGGCGAGACACCCACUUAdTdT | 347 | A-98192.1 | UAAGUGGGUGUCUCGCCUCdTdT | 576 |
| HAMP | AD-47147 | 242 | A-98193.1 | GAGGCGAGACACCCACUUUdTdT | 346 | A-98194.1 | AAAGUGGGUGUCUCGCCUCdTdT | 573 |
| HAMP | AD-47153 | 253 | A-98195.1 | CCCACUUCCCCAUCUGCAUdTdT | 356 | A-98196.1 | AUGCAGAUGGGGAAGUGGGdTdT | 584 |
| HAMP | AD-47159 | 258 | N-98197.1 | UUCCCCAUCUGCAUUUUCUdTdT | 360 | A-98198.1 | AGAAAAUGCAGAUGGGGAAdTdT | 588 |
| HAMP | AD-47165 | 261 | A-98199.1 | CCCAUCUGCAUUUUCUGCUdTdT | 361 | A-98200.1 | AGCAGAAAAUGCAGAUGGGdTdT | 589 |
| HAMP | AD-47124 | 275 | A-98201.1 | CUGCUGCGGCUGCUGUCAUdTdT | 370 | A-98202.1 | AUGACAGCAGCCGCAGCAGdTdT | 598 |

TABLE 5-continued

HAMP unmodified seqeunces

| Target | Duplex ID | Start Position | Antisense Name | Antisense Sequence | SEQ ID NO | Sense Name | Sense Sequence | SEQ ID NO |
|---|---|---|---|---|---|---|---|---|
| HAMP | AD-47136 | 276 | A-98205.1 | UGCUGCGGCUGCUG UCAUUdTdT | 371 | A-98206.1 | AAUGACAGCAGCC GCAGCAdTdT | 599 |
| HAMP | AD-47130 | 276 | A-98203.1 | UGCUGCGGCUGCUG UCAUAdTdT | 372 | A-98204.1 | UAUGACAGCAGCC GCAGCAdTdT | 601 |
| HAMP | AD-47142 | 278 | A-98207.1 | CUGCGGCUGCUGUC AUCGAdTdT | 374 | A-98208.1 | UCGAUGACAGCA GCCGCAGdTdT | 603 |
| HAMP | AD-47148 | 279 | A-98209.1 | UGCGGCUGCUGUCA UCGAUdTdT | 375 | A-98210.1 | AUCGAUGACAGC AGCCGCAdTdT | 604 |
| HAMP | AD-47160 | 280 | A-98213.1 | GCGGCUGCUGUCAU CGAUUdTdT | 376 | A-98214.1 | AAUCGAUGACAG CAGCCGCdTdT | 605 |
| HAMP | AD-47154 | 280 | A-98211.1 | GCGGCUGCUGUCAU CGAUAdTdT | 377 | A-98212.1 | UAUCGAUGACAG CAGCCGCdTdT | 607 |
| HAMP | AD-47166 | 281 | 4-98215.1 | CGGCUGCUGUCAUC GAUCAdTdT | 378 | A-98216.1 | UGAUCGAUGACA GCAGCCGdTdT | 608 |
| HAMP | AD-47125 | 282 | A-98217.1 | GGCUGCUGUCAUCG AUCAAdTdT | 379 | A-98218.1 | UUGAUCGAUGAC AGCAGCCdTdT | 609 |
| HAMP | AD-47131 | 283 | A-98219.1 | GCUGCUGUCAUCGA UCAAAdTdT | 380 | A-98220.1 | UUUGAUCGAUGA CAGCAGCdTdT | 610 |
| HAMP | AD-47137 | 284 | A-98221.1 | CUGCUGUCAUCGAU CAAAAdTdT | 382 | A-98222.1 | UUUUGAUCGAUG ACAGCAGdTdT | 612 |
| HAMP | AD-47143 | 284 | A-98223.1 | CUGCUGUCAUCGAU CAAAUdTdT | 381 | A-98224.1 | AUUUGAUCGAUG ACAGCAGdTdT | 611 |
| HAMP | AD-47149 | 285 | A-98225.1 | UGCUGUCAUCGAUC AAAGUdTdT | 384 | A-98226.1 | ACUUUGAUCGAU GACAGCAdTdT | 614 |
| HAMP | AD-47161 | 286 | A-98229.1 | GCUGUCAUCGAUCA AAGUUdTdT | 385 | A-98230.1 | AACUUUGAUCGA UGACAGCdTdT | 615 |
| HAMP | AD-47155 | 286 | 4-98227.1 | GCUGUCAUCGAUCA AAGUAdTdT | 386 | A-98228.1 | UACUUUGAUCGA UGACAGCdTdT | 617 |
| HAMP | AD-47167 | 287 | A-98231.1 | CUGUCAUCGAUCAA AGUGUdTdT | 388 | A-98232.1 | ACACUUUGAUCG AUGACAGdTdT | 618 |
| HAMP | AD-47132 | 288 | A-98235.1 | UGUCAUCGAUCAAA GUGUUdTdT | 389 | A-98236.1 | AACACUUUGAUC GAUGACAdTdT | 619 |
| HAMP | AD-47126 | 288 | A-98233.1 | UGUCAUCGAUCAAA GUGUAdTdT | 390 | A-98234.1 | UACACUUUGAUC GAUGACAdTdT | 621 |
| HAMP | AD-47138 | 290 | A-98237.1 | UCAUCGAUCAAAGU GUGGAdTdT | 392 | A-98238.1 | UCCACACUUUGA UCGAUGAdTdT | 622 |
| HAMP | AD-47144 | 290 | A-98239.1 | UCAUCGAUCAAAGU GUGGUdTdT | 393 | A-98240.1 | ACCACACUUUGAU CGAUGAdTdT | 623 |
| HAMP | AD-47095 | 291 | A-98151.1 | CAUCGAUCAAAGUG UGGGAdTdT | 395 | A-98152.1 | UCCCACACUUUGA UCGAUGdTdT | 625 |
| HAMP | AD-47156 | 295 | A-98243.1 | GAUCAAAGUGUGGG AUGUUdTdT | 399 | A-98244.1 | AACAUCCCACACU UUGAUCdTdT | 629 |
| HAMP | AD-47150 | 295 | A-98241.1 | GAUCAAAGUGUGGG AUGUAdTdT | 400 | A-98242.1 | UACAUCCCACACU UUGAUCdTdT | 631 |
| HAMP | AD-47162 | 299 | A-98245.1 | AAAGUGUGGGAUGU GCUGUdTdT | 407 | A-98246.1 | ACAGCACAUCCCA CACUUUdTdT | 637 |
| HAMP | AD-47078 | 307 | A-98067.1 | GGAUGUGCUGCAAG ACGUAdTdT | 413 | A-98068.1 | UACGUCUUGCAG CACAUCCdTdT | 644 |
| HAMP | AD-47084 | 309 | A-98069.1 | AUGUGCUGCAAGAC GUAGAdTdT | 414 | A-98070.1 | UCUACGUCUUGC AGCACAUdTdT | 646 |

TABLE 5-continued

HAMP unmodified seqeunces

| Target | Duplex ID | Start Position | Antisense Name | Antisense Sequence | SEQ ID NO | Sense Name | Sense Sequence | SEQ ID NO |
|---|---|---|---|---|---|---|---|---|
| HAMP | AD-47090 | 310 | A-98071.1 | UGUGCUGCAAGACGUAGAAdTdT | 415 | A-98072.1 | UUCUACGUCUUGCAGCACAdTdT | 648 |
| HAMP | AD-47096 | 313 | A-98073.1 | GCUGCAAGACGUAGAACCUdTdT | 416 | A-98074.1 | AGGUUCUACGUCUUGCAGCdTdT | 650 |
| HAMP | AD-47101 | 314 | A-98075.1 | CUGCAAGACGUAGAACCUAdTdT | 417 | A-98076.1 | UAGGUUCUACGUCUUGCAGdTdT | 707 |
| HAMP | AD-47106 | 322 | A-98077.1 | CGUAGAACCUACCUGCCCUdTdT | 418 | A-98078.1 | AGGGCAGGUAGGUUCUACGdTdT | 653 |
| HAMP | AD-47111 | 347 | A-98079.1 | GUCCCCUCCCUUCCUUAUUdTdT | 419 | A-98080.1 | AAUAAGGAAGGGAGGGGACdTdT | 1358 |
| HAMP | AD-47116 | 348 | A-98081.1 | UCCCCUCCCUUCCUUAUUUdTdT | 420 | A-98082.1 | AAAUAAGGAAGGGAGGGGAdTdT | 1359 |
| HAMP | AD-47079 | 349 | A-98083.1 | CCCCUCCCUUCCUUAUUUAdTdT | 421 | A-98084.1 | UAAAUAAGGAAGGGAGGGGdTdT | 1360 |
| HAMP | AD-47085 | 350 | A-98085.1 | CCCUCCCUUCCUUAUUUAUdTdT | 422 | A-98086.1 | AUAAAUAAGGAAGGGAGGGdTdT | 1361 |
| HAMP | AD-47091 | 351 | A-98087.1 | CCUCCCUUCCUUAUUUAUUdTdT | 423 | A-98088.1 | AAUAAAUAAGGAAGGGAGGdTdT | 1362 |
| HAMP | AD-47097 | 352 | A-98089.1 | CUCCCUUCCUUAUUUAUUAdTdT | 425 | A-98090.1 | UAAUAAAUAAGGAAGGGAGdTdT | 1363 |
| HAMP | AD-47102 | 352 | A-98091.1 | CUCCCUUCCUUAUUUAUUUdTdT | 424 | A-98092.1 | AAAUAAAUAAGGAAGGGAGdTdT | 1364 |
| HAMP | AD-47107 | 354 | A-98093.1 | CCCUUCCUUAUUUAUUCCUdTdT | 426 | A-98094.1 | AGGAAUAAAUAAGGAAGGGdTdT | 1365 |
| HAMP | AD-47112 | 355 | A-98095.1 | CCUUCCUUAUUUAUUCCUAdTdT | 427 | A-98096.1 | UAGGAAUAAAUAAGGAAGGdTdT | 1366 |
| HAMP | AD-47117 | 355 | A-98097.1 | CCUUCCUUAUUUAUUCCUUdTdT | 428 | A-98098.1 | AAGGAAUAAAUAAGGAAGGdTdT | 1367 |
| HAMP | AD-47086 | 356 | A-98101.1 | CUUCCUUAUUUAUCCUGUdTdt | 429 | A-98102.1 | ACAGGAAUAAAUAAGGAAGdTdT | 1368 |
| HAMP | AD-47080 | 356 | N-98099.1 | CUUCCUUAUUUAUUCCUGAdTdT | 430 | A-98100.1 | UCAGGAAUAAAUAAGGAAGdTdT | 1369 |
| HAMP | AD-47092 | 357 | A-98103.1 | UUCCUUAUUUAUUCCUGCUdTdT | 431 | A-98104.1 | AGCAGGAAUAAAUAAGGAAdTdT | 1370 |
| HAMP | AD-47103 | 358 | A-98107.1 | UCCUUAUUUAUUCCUGCUUdTdT | 432 | A-98108.1 | AAGCAGGAAUAAAUAAGGAdTdT | 1371 |
| HAMP | AD-47098 | 358 | A-98105.1 | UCCUUAUUUAUUCCUGCUAdTdT | 433 | A-98106.1 | UAGCAGGAAUAAAUAAGGAdTdT | 1372 |
| HAMP | AD-47113 | 359 | A-98111.1 | CCUUAUUUAUUCCUGCUGUdTdT | 434 | A-98112.1 | ACAGCAGGAAUAAAUAAGGdTdT | 1373 |
| HAMP | AD-47108 | 359 | A-98109.1 | CCUUAUUUAUUCCUGCUGAdTdT | 435 | A-98110.1 | UCAGCAGGAAUAAAUAAGGdTdT | 1374 |
| HAMP | AD-47118 | 363 | A-98113.1 | AUUUAUUCCUGCUGCCCCAdTdT | 436 | A-98114.1 | UGGGGCAGCAGGAAUAAUdTdT | 1375 |
| HAMP | AD-47081 | 365 | N-98115.1 | UUAUUCCUGCUGCCCCAGAdTdT | 437 | A-98116.1 | UCUGGGGCAGCAGGAAUAAdTdT | 1376 |
| HAMP | AD-47087 | 366 | A-98117.1 | UAUUCCUGCUGCCCCAGAAdTdT | 438 | A-98118.1 | UUCGGGGCAGCAGGAAUAdTdT | 1377 |
| HAMP | AD-47093 | 369 | A-98119.1 | UCCUGCUGCCCCAGAACAUdTdT | 439 | A-98120.1 | AUGUUCGGGGCAGCAGGAdTdT | 674 |

TABLE 5-continued

HAMP unmodified seqeunces

| Target | Duplex ID | Start Position | Antisense Name | Antisense Sequence | SEQ ID NO | Sense Name | Sense Sequence | SEQ ID NO |
|---|---|---|---|---|---|---|---|---|
| HAMP | AD-47099 | 370 | A-98121.1 | CCUGCUGCCCCAGAA CAUAdTdT | 440 | A-98122.1 | UAUGUUCUGGGG CAGCAGGdTdT | 676 |
| HAMP | AD-47104 | 373 | A-98123.1 | GCUGCCCCAGAACAU AGGUdTdT | 441 | A-98124.1 | ACCUAUGUUCUG GGGCAGCdTdT | 678 |
| HAMP | AD-47109 | 375 | A-98125.1 | UGCCCCAGAACAUAG GUCUdTdT | 442 | A-98126.1 | AGACCUAUGUUC UGGGGCAdTdT | 680 |
| HAMP | AD-47114 | 376 | A-93127.1 | GCCCCAGAACAUAGG UCUUdTdT | 443 | A-98128.1 | AAGACCUAUGUU CUGGGGCdTdT | 681 |
| HAMP | AD-47119 | 379 | A-98129.1 | CCAGAACAUAGGUC UUGGAdTdT | 444 | A-98130.1 | UCCAAGACCUAUG UUCUGGdTdT | 684 |
| HAMP | AD-47082 | 380 | A-98131.1 | CAGAACAUAGGUCU UGGAAdTdT | 445 | A-98132.1 | UUCCAAGACCUAU GUUCUGdTdT | 687 |
| HAMP | AD-47088 | 381 | A-98133.1 | AGAACAUAGGUCUU GGAAUdTdT | 446 | A-98134.1 | AUUCCAAGACCUA UGUUCUdTdT | 689 |
| HAMP | AD-47094 | 382 | A-98135.1 | GAACAUAGGUCUUG GAAUAdTdT | 30 | A-98136.1 | UAUUCCAAGACCU AUGUUCdTdT | 44 |
| HAMP | AD-47094 | 382 | N-98135.1 | GAACAUAGGUCUUG GAAUAdTdT | 30 | A-98136.1 | UAUUCCAAGACCU AUGUUCdTdT | 44 |
| HAMP | AD-48210 | 382 | A-100210.1 | GAACACAGGUCUUG GAAUAdTdT | 448 | A-100211.1 | UAUUCCAAGACCU GUGUUCdTdT | 692 |
| HAMP | AD-47100 | 383 | A-98137.1 | AACAUAGGUCUUGG AAUAAdTdT | 450 | A-98138.1 | UUAUUCCAAGACC UAUGUUdTdT | 695 |
| HAMP | AD-47105 | 396 | A-98139.1 | GAAUAAAAUGGCUG GUUCUdTdT | 452 | A-98140.1 | AGAACCAGCCAUU UUAUUCdTdT | 697 |
| HAMP | AD-47110 | 398 | A-98141.3 | AUAAAAUGGCUGGU UCUUUdTdT | 453 | A-98142.1 | AAAGAACCAGCCA UUUUAdTdT | 700 |
| HAMP | AD-47115 | 399 | A-98143.1 | UAAAAUGGCUGGUU CUUUUdTdT | 454 | A-98144.1 | AAAAGAACCAGCC AUUUUAdTdT | 702 |
| HAMP | AD-47120 | 402 | A-98145.1 | AAUGGCUGGUUCUU UUGUUdTdT | 455 | A-98146.1 | AACAAAAGAACCA GCCAUUdTdT | 703 |
| HAMP | AD-47083 | 403 | A-98147.1 | AUGGCUGGUUCUUU UGUUUdTdT | 456 | A-98148.1 | AAACAAAAGAACC AGCCAUdTdT | 704 |
| HAMP | AD-47089 | 407 | A-98149.1 | CUGGUUCUUUUGUU UUCCAdTdT | 457 | A-98150.1 | UGGAAAACAAAA GAACCAGdTdT | 705 |

TABLE 6

HAMP single dose screen (Modified Duplexes, Dual Luciferase Assay)

| Target | Duplex ID | Start Position | 10 nM | | 0.1 nM | | 0.01 nM | |
|---|---|---|---|---|---|---|---|---|
| | | | Avg | SD | Avg | SD | Avg | SD |
| HAMP | AD-45073 | 2 | 107.73 | 0.50 | 92.94 | 7.41 | | |
| HAMP | AD-45079 | 7 | 110.26 | 7.14 | 101.78 | 5.79 | | |
| HAMP | AD-45085 | 16 | 90.81 | 0.48 | 96.06 | 2.19 | | |
| HAMP | AD-29928 | 43 | 102.01 | 15.80 | 96.01 | 1.70 | | |
| HAMP | AD-45674 | 43 | 94.81 | 4.68 | 108.44 | 7.69 | | |
| HAMP | AD-45680 | 43 | 109.80 | 2.04 | 111.06 | 5.64 | | |
| HAMP | AD-45686 | 48 | 89.78 | 15.04 | 110.29 | 0.29 | | |
| HAMP | AD-45698 | 48 | 103.33 | 8.83 | 112.53 | 1.57 | | |
| HAMP | AD-45692 | 48 | 110.03 | 6.99 | 115.05 | 0.14 | | |
| HAMP | AD-45354 | 51 | 111.45 | 7.56 | 105.64 | 4.49 | | |
| HAMP | AD-29929 | 54 | 99.33 | 11.26 | 104.08 | 6.92 | | |
| HAMP | AD-45091 | 55 | 116.71 | 3.20 | 102.27 | 0.81 | | |
| HAMP | AD-29930 | 59 | 88.47 | 0.38 | 102.18 | 7.79 | | |

TABLE 6-continued

HAMP single dose screen (Modified Duplexes, Dual Luciferase Assay)

| | | | 10 nM | | 0.1 nM | | 0.01 nM | |
|---|---|---|---|---|---|---|---|---|
| Target | Duplex ID | Start Position | Avg | SD | Avg | SD | Avg | SD |
| HAMP | AD-29931 | 60 | 104.54 | 3.36 | 104.80 | 3.55 | | |
| HAMP | AD-45704 | 60 | 142.74 | 0.80 | 122.02 | 1.37 | | |
| HAMP | AD-45710 | 60 | 135.87 | 3.55 | 129.05 | 1.72 | | |
| HAMP | AD-29932 | 61 | 103.48 | 6.29 | 108.36 | 1.31 | | |
| HAMP | AD-29933 | 62 | 110.13 | 1.03 | 104.36 | 6.68 | | |
| HAMP | AD-45675 | 62 | 113.15 | 1.01 | 107.56 | 0.54 | | |
| HAMP | AD-45716 | 62 | 111.06 | 12.39 | 113.09 | 8.16 | | |
| HAMP | AD-29934 | 63 | 101.68 | 3.60 | 96.37 | 6.01 | | |
| HAMP | AD-29935 | 64 | 100.63 | 8.13 | 93.98 | 8.75 | | |
| HAMP | AD-45687 | 64 | 103.09 | 8.83 | 105.61 | 3.09 | | |
| HAMP | AD-45681 | 64 | 117.87 | 2.59 | 111.72 | 1.69 | | |
| HAMP | AD-29936 | 66 | 98.38 | 12.53 | 98.56 | 13.20 | | |
| HAMP | AD-29937 | 67 | 93.41 | 2.34 | 97.50 | 10.28 | | |
| HAMP | AD-45699 | 67 | 47.01 | 9.59 | 98.55 | 3.80 | | |
| HAMP | AD-45693 | 67 | 84.68 | 3.15 | 113.79 | 5.11 | | |
| HAMP | AD-45711 | 68 | 113.03 | 9.72 | 108.10 | 3.83 | | |
| HAMP | AD-45717 | 68 | 99.40 | 12.84 | 110.38 | 0.04 | | |
| HAMP | AD-45705 | 68 | 110.22 | 3.84 | 117.90 | 9.96 | | |
| HAMP | AD-45682 | 69 | 96.60 | 3.60 | 103.41 | 1.06 | | |
| HAMP | AD-45688 | 69 | 100.44 | 9.14 | 104.93 | 5.18 | | |
| HAMP | AD-45676 | 69 | 106.83 | 9.15 | 106.73 | 1.89 | | |
| HAMP | AD-45360 | 70 | 92.88 | 0.12 | 93.73 | 2.85 | | |
| HAMP | AD-45366 | 71 | 92.46 | 2.58 | 99.04 | 0.39 | | |
| HAMP | AD-29938 | 72 | 62.08 | 21.83 | 75.55 | 6.85 | | |
| HAMP | AD-45372 | 73 | 59.85 | 2.76 | 96.31 | 5.86 | | |
| HAMP | AD-45700 | 74 | 12.85 | 5.11 | 63.97 | 14.79 | | |
| HAMP | AD-29939 | 74 | 36.40 | 19.57 | 67.18 | 9.10 | | |
| HAMP | AD-45694 | 74 | 17.85 | 4.97 | 90.43 | 0.13 | | |
| HAMP | AD-29940 | 75 | 49.83 | 6.31 | 76.05 | 7.08 | | |
| HAMP | AD-45712 | 76 | 32.07 | 2.85 | 63.27 | 3.48 | | |
| HAMP | AD-29941 | 76 | 81.10 | 0.03 | 97.49 | 9.32 | | |
| HAMP | AD-45706 | 76 | 43.48 | 6.67 | 97.60 | 1.61 | | |
| HAMP | AD-45097 | 88 | 50.62 | 0.50 | 71.18 | 1.94 | | |
| HAMP | AD-45103 | 91 | 53.20 | 9.02 | 96.52 | 7.45 | | |
| HAMP | AD-45378 | 116 | 95.96 | 1.21 | 103.17 | 3.99 | | |
| HAMP | AD-45383 | 117 | 99.99 | 2.44 | 104.79 | 5.38 | | |
| HAMP | AD-45388 | 118 | 98.52 | 4.10 | 105.96 | 3.21 | | |
| HAMP | AD-45393 | 120 | 103.62 | 5.17 | 102.44 | 6.38 | | |
| HAMP | AD-45355 | 121 | 73.28 | 0.51 | 96.56 | 1.06 | | |
| HAMP | AD-45361 | 122 | 98.67 | 0.23 | 99.82 | 4.47 | | |
| HAMP | AD-45367 | 123 | 90.48 | 1.28 | 102.75 | 4.07 | | |
| HAMP | AD-45373 | 126 | 106.01 | 8.36 | 99.38 | 4.05 | | |
| HAMP | AD-45109 | 132 | 85.86 | 5.55 | 95.06 | 3.75 | | |
| HAMP | AD-45115 | 140 | 100.97 | 1.25 | 90.90 | 9.28 | | |
| HAMP | AD-45074 | 142 | 95.53 | 2.12 | 95.37 | 2.74 | | |
| HAMP | AD-45677 | 146 | 58.20 | 5.06 | 80.37 | 5.46 | | |
| HAMP | AD-45683 | 146 | 67.80 | 1.12 | 88.08 | 7.96 | | |
| HAMP | AD-45718 | 146 | 76.16 | 3.48 | 100.37 | 3.35 | | |
| HAMP | AD-45080 | 149 | 52.89 | 1.28 | 84.16 | 0.02 | | |
| HAMP | AD-45379 | 150 | 48.97 | 3.64 | 103.43 | 1.19 | | |
| HAMP | AD-29942 | 151 | 88.17 | 4.85 | 97.49 | 7.95 | | |
| HAMP | AD-29943 | 152 | 43.37 | 9.93 | 73.15 | 23.90 | | |
| HAMP | AD-29944 | 153 | 80.38 | 9.90 | 92.54 | 7.85 | | |
| HAMP | AD-45695 | 153 | 65.57 | 2.52 | 92.72 | 5.87 | | |
| HAMP | AD-45689 | 153 | 72.67 | 0.78 | 93.00 | 2.67 | | |
| HAMP | AD-29945 | 154 | 69.81 | 13.13 | 76.49 | 17.11 | | |
| HAMP | AD-29946 | 155 | 75.80 | 1.18 | 80.39 | 14.15 | | |
| HAMP | AD-45713 | 157 | 70.69 | 1.76 | 94.45 | 0.39 | | |
| HAMP | AD-45707 | 157 | 71.62 | 6.17 | 94.94 | 2.22 | | |
| HAMP | AD-45701 | 157 | 79.39 | 1.97 | 101.46 | 0.70 | | |
| HAMP | AD-45384 | 159 | 89.86 | 1.67 | 102.53 | 2.37 | | |
| HAMP | AD-45389 | 160 | 41.14 | 0.44 | 90.29 | 3.94 | | |
| HAMP | AD-45678 | 161 | 55.04 | 0.96 | 76.03 | 3.63 | | |
| HAMP | AD-45719 | 161 | 55.02 | 5.94 | 84.45 | 2.01 | | |
| HAMP | AD-29947 | 161 | 81.45 | 6.55 | 89.78 | 7.92 | | |
| HAMP | AD-45690 | 162 | 105.99 | 3.29 | 97.21 | 2.61 | | |
| HAMP | AD-45696 | 162 | 105.48 | 0.08 | 99.13 | 0.28 | | |
| HAMP | AD-45684 | 162 | 96.14 | 6.48 | 104.09 | 2.52 | | |
| HAMP | AD-30016 | 163 | 57.89 | 8.28 | 90.60 | 14.06 | | |
| HAMP | AD-45394 | 164 | 87.68 | 5.01 | 108.27 | 2.32 | | |
| HAMP | AD-45702 | 165 | 70.60 | 2.02 | 93.12 | 5.12 | | |
| HAMP | AD-45708 | 165 | 74.75 | 3.73 | 98.51 | 2.26 | | |
| HAMP | AD-45714 | 165 | 73.26 | 2.24 | 102.34 | 12.47 | | |
| HAMP | AD-29949 | 166 | 102.90 | 8.09 | 91.62 | 0.16 | | |

TABLE 6-continued

HAMP single dose screen (Modified Duplexes, Dual Luciferase Assay)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-45086 | 167 | 120.81 | 3.27 | 106.79 | 7.19 | | |
| HAMP | AD-45356 | 168 | 81.17 | 4.40 | 93.13 | 0.76 | | |
| HAMP | AD-45685 | 169 | 114.45 | 9.16 | 98.53 | 0.41 | | |
| HAMP | AD-45679 | 169 | 105.22 | 9.07 | 101.56 | 5.80 | | |
| HAMP | AD-45720 | 169 | 121.03 | 5.25 | 110.57 | 1.75 | | |
| HAMP | AD-45703 | 170 | 44.33 | 1.60 | 79.12 | 4.45 | | |
| HAMP | AD-45697 | 170 | 46.91 | 2.65 | 87.12 | 1.48 | | |
| HAMP | AD-45691 | 170 | 54.15 | 1.94 | 92.73 | 6.86 | | |
| HAMP | AD-45362 | 189 | 40.88 | 0.51 | 88.62 | 2.54 | | |
| HAMP | AD-45368 | 190 | 31.23 | 1.19 | 95.59 | 2.85 | | |
| HAMP | AD-45374 | 199 | 101.82 | 3.03 | 101.10 | 0.65 | | |
| HAMP | AD-45092 | 222 | 87.17 | 5.48 | 98.58 | 1.36 | | |
| HAMP | AD-45721 | 228 | 46.67 | 6.31 | 81.09 | 9.13 | | |
| HAMP | AD-45715 | 228 | 49.86 | 3.40 | 88.14 | 4.98 | | |
| HAMP | AD-45709 | 228 | 77.17 | 5.09 | 98.27 | 3.31 | | |
| HAMP | AD-45380 | 230 | 62.83 | 3.09 | 103.76 | 1.31 | | |
| HAMP | AD-45385 | 231 | 98.28 | 0.86 | 102.61 | 0.12 | | |
| HAMP | AD-29950 | 232 | 55.13 | 8.89 | 67.22 | 10.51 | | |
| HAMP | AD-45390 | 233 | 43.22 | 3.42 | 94.61 | 0.86 | | |
| HAMP | AD-29951 | 234 | 37.28 | 9.48 | 53.43 | 13.93 | | |
| HAMP | AD-45395 | 235 | 60.56 | 0.93 | 96.88 | 1.63 | | |
| HAMP | AD-45727 | 239 | 41.79 | 5.36 | 73.07 | 5.68 | | |
| HAMP | AD-45732 | 239 | 40.15 | 8.90 | 73.60 | 14.88 | | |
| HAMP | AD-29952 | 239 | 97.66 | 18.17 | 104.87 | 4.70 | | |
| HAMP | AD-29953 | 240 | 86.68 | 10.48 | 88.35 | 7.38 | | |
| HAMP | AD-30017 | 241 | 33.76 | 16.25 | 60.73 | 30.76 | | |
| HAMP | AD-30018 | 242 | 41.44 | 14.83 | 70.97 | 23.75 | | |
| HAMP | AD-45737 | 242 | 17.97 | 4.49 | 71.13 | 9.76 | | |
| HAMP | AD-29956 | 246 | 89.56 | 4.13 | 97.82 | 5.97 | | |
| HAMP | AD-45357 | 247 | 82.69 | 2.17 | 93.22 | 4.53 | | |
| HAMP | AD-45363 | 248 | 93.32 | 5.91 | 91.24 | 0.20 | | |
| HAMP | AD-45747 | 251 | 70.65 | 8.85 | 97.73 | 2.26 | | |
| HAMP | AD-45752 | 251 | 89.51 | 3.39 | 98.35 | 2.19 | | |
| HAMP | AD-45757 | 251 | 82.94 | 6.75 | 102.34 | 3.76 | | |
| HAMP | AD-29957 | 252 | 81.99 | 11.58 | 93.00 | 9.35 | | |
| HAMP | AD-45399 | 253 | 64.38 | 0.64 | 97.91 | 2.54 | | |
| HAMP | AD-45098 | 255 | 82.48 | 2.01 | 76.84 | 2.07 | | |
| HAMP | AD-45400 | 256 | 41.85 | 0.69 | 73.87 | 3.09 | | |
| HAMP | AD-45381 | 257 | 33.48 | 1.75 | 76.90 | 0.24 | | |
| HAMP | AD-45401 | 258 | 20.19 | 1.67 | 47.65 | 3.20 | | |
| HAMP | AD-29958 | 261 | 56.65 | 14.92 | 84.66 | 28.04 | | |
| HAMP | AD-45391 | 262 | 24.94 | 0.82 | 89.45 | 2.12 | | |
| HAMP | AD-29959 | 267 | 31.48 | 11.63 | 63.85 | 30.99 | | |
| HAMP | AD-29960 | 268 | 79.91 | 12.47 | 93.49 | 6.68 | | |
| HAMP | AD-30019 | 270 | 63.27 | 10.61 | 74.99 | 18.30 | | |
| HAMP | AD-45396 | 271 | 119.24 | 2.30 | 111.41 | 3.10 | | |
| HAMP | AD-45358 | 272 | 94.71 | 8.18 | 101.07 | 2.21 | | |
| HAMP | AD-45364 | 273 | 84.76 | 0.19 | 96.53 | 5.62 | | |
| HAMP | AD-29962 | 274 | 76.15 | 9.81 | 86.71 | 13.14 | | |
| HAMP | AD-45370 | 275 | 72.03 | 3.07 | 96.93 | 2.90 | | |
| HAMP | AD-45728 | 276 | 16.69 | 2.26 | 33.05 | 13.53 | | |
| HAMP | AD-45722 | 276 | 14.19 | 2.15 | 36.38 | 8.98 | | |
| HAMP | AD-29963 | 276 | 33.66 | 10.79 | 68.80 | 33.38 | | |
| HAMP | AD-45104 | 278 | 68.72 | 2.74 | 87.22 | 0.49 | | |
| HAMP | AD-29964 | 279 | 71.02 | 18.87 | 76.03 | 27.29 | | |
| HAMP | AD-45738 | 280 | 50.02 | 8.64 | 70.44 | 7.26 | | |
| HAMP | AD-45733 | 280 | 57.29 | 5.28 | 84.47 | 5.76 | | |
| HAMP | AD-29965 | 281 | 55.85 | 8.35 | 72.34 | 23.30 | | |
| HAMP | AD-30020 | 283 | 68.86 | 8.88 | 66.02 | 23.24 | | |
| HAMP | AD-45748 | 284 | 21.85 | 1.77 | 35.95 | 6.98 | | |
| HAMP | AD-45743 | 284 | 29.01 | 1.73 | 42.99 | 5.69 | | |
| HAMP | AD-30021 | 284 | 42.30 | 7.75 | 66.28 | 27.47 | | |
| HAMP | AD-11441 | 285 | 15.04 | 8.59 | 34.60 | 10.87 | 63.42 | 16.67 |
| HAMP | AD-45758 | 286 | 17.08 | 0.43 | 33.34 | 3.43 | | |
| HAMP | AD-45753 | 286 | 25.19 | 4.02 | 80.83 | 6.73 | | |
| HAMP | AD-29968 | 286 | 57.05 | 12.26 | 85.22 | 13.56 | | |
| HAMP | AD-29969 | 287 | 81.97 | 16.19 | 102.53 | 21.58 | | |
| HAMP | AD-45729 | 288 | 9.67 | 1.06 | 32.83 | 13.93 | | |
| HAMP | AD-45723 | 288 | 20.87 | 3.89 | 66.57 | 4.73 | | |
| HAMP | AD-29970 | 288 | 65.21 | 1.72 | 84.12 | 5.99 | | |
| HAMP | AD-45744 | 290 | 40.34 | 1.92 | 56.56 | 3.09 | | |
| HAMP | AD-45739 | 290 | 29.46 | 2.77 | 67.24 | 9.80 | | |
| HAMP | AD-45734 | 290 | 53.39 | 2.32 | 83.49 | 1.19 | | |
| HAMP | AD-11436 | 291 | 19.18 | 8.22 | 42.74 | 14.18 | 76.43 | 23.00 |

TABLE 6-continued

HAMP single dose screen (Modified Duplexes, Dual Luciferase Assay)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-29971 | 291 | 29.02 | 9.90 | 52.08 | 14.09 | | |
| HAMP | AD-45376 | 292 | 47.54 | 0.51 | 87.50 | 1.26 | | |
| HAMP | AD-45382 | 293 | 37.05 | 0.44 | 93.25 | 4.03 | | |
| HAMP | AD-29972 | 294 | 32.08 | 7.08 | 53.51 | 17.12 | | |
| HAMP | AD-45754 | 295 | 30.78 | 4.04 | 62.74 | 0.50 | | |
| HAMP | AD-45749 | 295 | 48.49 | 11.81 | 92.97 | 1.08 | | |
| HAMP | AD-29973 | 295 | 101.69 | 8.46 | 97.65 | 8.24 | | |
| HAMP | AD-45730 | 296 | 78.23 | 2.00 | 86.13 | 5.69 | | |
| HAMP | AD-45724 | 296 | 82.07 | 4.46 | 86.67 | 2.23 | | |
| HAMP | AD-45759 | 296 | 92.10 | 6.68 | 97.71 | 2.40 | | |
| HAMP | AD-45110 | 297 | 69.77 | 2.74 | 90.01 | 2.11 | | |
| HAMP | AD-45387 | 298 | 98.34 | 5.75 | 108.20 | 1.85 | | |
| HAMP | AD-45740 | 299 | 124.12 | 4.66 | 101.03 | 6.78 | | |
| HAMP | AD-45745 | 299 | 131.69 | 10.22 | 103.23 | 1.76 | | |
| HAMP | AD-45735 | 299 | 111.96 | 3.19 | 103.86 | 6.46 | | |
| HAMP | AD-29974 | 300 | 34.04 | 6.78 | 53.98 | 24.23 | | |
| HAMP | AD-29975 | 301 | 53.80 | 12.05 | 67.73 | 22.08 | | |
| HAMP | AD-45116 | 306 | 25.93 | 2.21 | 55.49 | 5.82 | | |
| HAMP | AD-45075 | 307 | 19.84 | 2.98 | 63.83 | 1.45 | | |
| HAMP | AD-45081 | 309 | 14.66 | 0.55 | 38.67 | 3.25 | | |
| HAMP | AD-45087 | 310 | 11.95 | 0.17 | 29.23 | 1.61 | | |
| HAMP | AD-45093 | 313 | 14.07 | 0.68 | 45.44 | 2.30 | | |
| HAMP | AD-45099 | 322 | 108.37 | 1.23 | 107.51 | 2.82 | | |
| HAMP | AD-45105 | 369 | 102.93 | 6.40 | 101.31 | 4.27 | | |
| HAMP | AD-45111 | 370 | 117.00 | 3.72 | 104.04 | 2.33 | | |
| HAMP | AD-45117 | 373 | 99.33 | 0.61 | 102.95 | 0.52 | | |
| HAMP | AD-45076 | 375 | 62.84 | 4.39 | 90.32 | 1.71 | | |
| HAMP | AD-45082 | 376 | 75.58 | 1.59 | 95.17 | 0.21 | | |
| HAMP | AD-45088 | 379 | 83.27 | 12.84 | 101.84 | 1.83 | | |
| HAMP | AD-45094 | 380 | 99.51 | 2.23 | 102.51 | 2.51 | | |
| HAMP | AD-45100 | 381 | 112.68 | 6.11 | 107.46 | 7.75 | | |
| HAMP | AD-45106 | 383 | 138.19 | 1.98 | 112.49 | 0.89 | | |
| HAMP | AD-45112 | 396 | 128.11 | 6.65 | 106.21 | 3.64 | | |
| HAMP | AD-45118 | 398 | 116.86 | 12.51 | 103.78 | 4.53 | | |
| HAMP | AD-45077 | 399 | 98.64 | 1.22 | 103.30 | 2.55 | | |
| HAMP | AD-45083 | 402 | 114.82 | 2.26 | 104.50 | 0.17 | | |
| HAMP | AD-45089 | 403 | 107.59 | 7.70 | 103.43 | 1.69 | | |

Data are expressed as percent of mock or AD-1955.

TABLE 7

HAMP single dose screen (Unmodified Duplexes, Human Endogenous)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-47121 | 62 | 22.18 | 1.49 | 60.31 | 16.26 | | |
| HAMP | AD-47133 | 67 | 27.53 | 1.12 | 53.58 | 2.92 | | |
| HAMP | AD-47127 | 67 | 20.45 | 4.63 | 54.16 | 7.57 | | |
| HAMP | AD-47145 | 74 | 19.51 | 6.65 | 54.67 | 10.88 | | |
| HAMP | AD-47139 | 74 | 20.72 | 0.17 | 58.12 | 2.90 | | |
| HAMP | AD-47157 | 76 | 10.07 | 0.35 | 28.24 | 6.49 | | |
| HAMP | AD-47151 | 76 | 12.08 | 1.83 | 33.95 | 2.14 | | |
| HAMP | AD-47163 | 132 | 8.58 | 0.51 | 44.65 | 17.97 | | |
| HAMP | AD-47122 | 140 | 25.66 | 0.45 | 72.63 | 2.29 | | |
| HAMP | AD-47128 | 146 | 30.88 | 3.04 | 64.36 | 2.04 | | |
| HAMP | AD-47134 | 146 | 48.07 | 0.91 | 72.33 | 12.48 | | |
| HAMP | AD-47140 | 155 | 15.20 | 1.25 | 34.69 | 0.30 | | |
| HAMP | AD-47152 | 157 | 13.21 | 6.55 | 28.17 | 1.17 | | |
| HAMP | AD-47146 | 157 | 14.77 | 0.68 | 32.02 | 1.58 | | |
| HAMP | AD-47158 | 160 | 9.73 | 1.66 | 32.92 | 1.87 | | |
| HAMP | AD-47164 | 161 | 5.71 | 0.44 | 32.90 | 2.89 | | |
| HAMP | AD-47123 | 161 | 7.88 | 3.02 | 39.31 | 19.09 | | |
| HAMP | AD-47135 | 162 | 26.84 | 0.87 | 74.06 | 15.78 | | |
| HAMP | AD-47129 | 162 | 27.18 | 1.57 | 83.62 | 13.59 | | |
| HAMP | AD-47141 | 242 | 110.80 | 16.98 | 127.17 | 42.39 | | |
| HAMP | AD-47147 | 242 | 116.01 | 9.55 | 132.52 | 28.61 | | |
| HAMP | AD-47153 | 253 | 34.69 | 7.47 | 66.88 | 2.08 | | |
| HAMP | AD-47159 | 258 | 33.41 | 1.23 | 57.26 | 7.97 | | |
| HAMP | AD-47165 | 261 | 25.12 | 0.71 | 85.70 | 6.86 | | |

TABLE 7-continued

HAMP single dose screen (Unmodified Duplexes, Human Endogenous)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-47124 | 275 | 36.35 | 7.66 | 87.65 | 11.44 | | |
| HAMP | AD-47136 | 276 | 6.06 | 0.70 | 40.72 | 13.94 | | |
| HAMP | AD-47130 | 276 | 8.76 | 0.58 | 46.31 | 13.29 | | |
| HAMP | AD-47142 | 278 | 24.10 | 2.89 | 56.75 | 18.44 | | |
| HAMP | AD-47148 | 279 | 19.36 | 1.09 | 57.95 | 18.21 | | |
| HAMP | AD-47160 | 280 | 5.75 | 0.73 | 35.24 | 4.98 | | |
| HAMP | AD-47154 | 280 | 15.01 | 3.91 | 36.32 | 0.45 | | |
| HAMP | AD-47166 | 281 | 11.98 | 0.47 | 51.40 | 12.88 | | |
| HAMP | AD-47125 | 282 | 14.62 | 1.15 | 54.37 | 11.47 | | |
| HAMP | AD-47131 | 283 | 8.74 | 0.45 | 42.66 | 12.21 | | |
| HAMP | AD-47137 | 284 | 9.97 | 0.73 | 36.35 | 5.96 | | |
| HAMP | AD-47143 | 284 | 9.66 | 0.84 | 39.72 | 8.37 | | |
| HAMP | AD-47149 | 285 | 13.85 | 0.47 | 47.21 | 9.13 | | |
| HAMP | AD-47161 | 286 | 7.28 | 0.89 | 31.75 | 8.03 | | |
| HAMP | AD-47155 | 286 | 8.27 | 0.74 | 36.03 | 14.37 | | |
| HAMP | AD-47167 | 287 | 8.98 | 0.14 | 41.61 | 6.60 | | |
| HAMP | AD-47132 | 288 | 9.08 | 0.17 | 38.01 | 4.01 | | |
| HAMP | AD-47126 | 288 | 8.59 | 3.66 | 40.28 | 10.49 | | |
| HAMP | AD-47138 | 290 | 41.75 | 1.27 | 81.70 | 14.64 | | |
| HAMP | AD-47144 | 290 | 60.81 | 13.34 | 107.58 | 15.10 | | |
| HAMP | AD-47095 | 291 | 34.79 | 5.48 | 58.98 | 7.36 | | |
| HAMP | AD-47156 | 295 | 39.09 | 4.26 | 90.08 | 4.38 | | |
| HAMP | AD-47150 | 295 | 53.01 | 9.58 | 99.42 | 9.61 | | |
| HAMP | AD-47162 | 299 | 122.90 | 8.44 | 123.74 | 15.71 | | |
| HAMP | AD-47078 | 307 | 26.81 | 9.00 | 59.79 | 15.73 | | |
| HAMP | AD-47084 | 309 | 31.16 | 5.91 | 59.33 | 19.95 | | |
| HAMP | AD-47090 | 310 | 15.07 | 5.19 | 49.74 | 11.70 | | |
| HAMP | AD-47096 | 313 | 49.34 | 9.86 | 68.64 | 0.71 | | |
| HAMP | AD-47101 | 314 | 13.36 | 5.68 | 38.13 | 10.64 | | |
| HAMP | AD-47106 | 322 | 29.91 | 1.99 | 61.30 | 1.25 | | |
| HAMP | AD-47111 | 347 | 21.57 | 4.45 | 46.65 | 10.06 | | |
| HAMP | AD-47116 | 348 | 32.95 | 7.34 | 65.00 | 10.06 | | |
| HAMP | AD-47079 | 349 | 10.10 | 2.16 | 24.36 | 4.46 | | |
| HAMP | AD-47085 | 350 | 8.08 | 5.13 | 20.39 | 9.47 | | |
| HAMP | AD-47091 | 351 | 20.73 | 6.86 | 42.28 | 5.15 | | |
| HAMP | AD-47097 | 352 | 10.57 | 2.97 | 24.58 | 3.18 | | |
| HAMP | AD-47102 | 352 | 15.48 | 7.81 | 25.60 | 8.37 | | |
| HAMP | AD-47107 | 354 | 50.89 | 12.39 | 61.80 | 6.52 | | |
| HAMP | AD-47112 | 355 | 42.93 | 6.42 | 53.00 | 3.93 | | |
| HAMP | AD-47117 | 355 | 33.82 | 2.18 | 60.78 | 7.57 | | |
| HAMP | AD-47086 | 356 | 16.50 | 3.69 | 34.88 | 9.79 | | |
| HAMP | AD-47080 | 356 | 13.76 | 3.39 | 38.95 | 7.09 | | |
| HAMP | AD-47092 | 357 | 35.01 | 5.39 | 48.61 | 6.81 | | |
| HAMP | AD-47103 | 356 | 45.09 | 9.10 | 66.18 | 7.81 | | |
| HAMP | AD-47098 | 358 | 63.20 | 11.74 | 70.69 | 1.23 | | |
| HAMP | AD-47113 | 359 | 27.42 | 9.95 | 49.88 | 7.22 | | |
| HAMP | AD-47108 | 359 | 30.30 | 9.89 | 52.33 | 12.30 | | |
| HAMP | AD-47118 | 363 | 7.45 | 0.35 | 19.20 | 1.31 | | |
| HAMP | AD-47081 | 365 | 4.25 | 1.97 | 22.94 | 6.70 | | |
| HAMP | AD-47087 | 366 | 9.49 | 2.18 | 37.51 | 12.04 | | |
| HAMP | AD-47093 | 369 | 4.75 | 1.38 | 23.36 | 3.30 | | |
| HAMP | AD-47099 | 370 | 5.05 | 0.01 | 17.71 | 7.66 | | |
| HAMP | AD-47104 | 373 | 32.32 | 8.82 | 37.72 | 8.15 | | |
| HAMP | AD-47109 | 375 | 25.45 | 4.46 | 35.56 | 1.25 | | |
| HAMP | AD-47114 | 376 | 10.65 | 4.55 | 17.30 | 6.01 | | |
| HAMP | AD-47119 | 379 | 7.99 | 0.50 | 17.44 | 6.45 | | |
| HAMP | AD-47082 | 380 | 13.13 | 1.08 | 27.19 | 8.88 | | |
| HAMP | AD-47088 | 381 | 5.80 | 2.75 | 12.26 | 7.13 | | |
| HAMP | AD-47094 | 382 | 5.59 | 2.35 | 11.95 | 7.39 | | |
| HAMP | AD-47094 | 382 | 8.63 | 3.05 | 14.02 | 2.30 | 22.83 | 0.56 |
| HAMP | AD-48210 | 382 | 7.43 | 7.88 | 17.06 | 4.17 | 30.21 | 0.63 |
| HAMP | AD-47100 | 383 | 3.80 | 2.75 | 8.41 | 3.86 | | |
| HAMP | AD-47105 | 396 | 6.56 | 2.25 | 12.11 | 4.90 | | |
| HAMP | AD-47110 | 398 | 10.42 | 5.14 | 21.44 | 0.24 | | |
| HAMP | AD-47115 | 399 | 4.86 | 0.27 | 9.25 | 1.57 | | |
| HAMP | AD-47120 | 402 | 5.78 | 0.12 | 15.68 | 0.67 | | |
| HAMP | AD-47083 | 403 | 4.36 | 1.88 | 14.49 | 5.26 | | |
| HAMP | AD-47089 | 407 | 17.68 | 1.22 | 21.61 | 6.91 | | |

Data are expressed as percent of mock.

TABLE 8

| | | | \multicolumn{2}{c|}{10 nM} | \multicolumn{2}{c|}{0.1 nM} | \multicolumn{2}{c|}{0.01 nM} |

HAMP single dose screen (Modified Duplexes, Human Endogenous)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-47031 | 62 | 15.53 | 6.23 | 42.68 | 4.24 | | |
| HAMP | AD-47043 | 67 | 21.87 | 1.62 | 50.05 | 4.67 | | |
| HAMP | AD-47037 | 67 | 23.85 | 4.92 | 53.84 | 0.43 | | |
| HAMP | AD-47055 | 74 | 31.38 | 2.06 | 59.08 | 4.48 | | |
| HAMP | AD-47049 | 74 | 30.11 | 3.10 | 64.35 | 3.66 | | |
| HAMP | AD-47067 | 76 | 8.71 | 1.38 | 28.60 | 2.87 | | |
| HAMP | AD-47061 | 76 | 11.78 | 3.07 | 29.53 | 0.18 | | |
| HAMP | AD-47032 | 140 | 37.89 | 8.04 | 60.90 | 3.74 | | |
| HAMP | AD-47038 | 146 | 33.92 | 2.79 | 53.24 | 7.14 | | |
| HAMP | AD-47044 | 146 | 39.99 | 7.45 | 60.74 | 5.99 | | |
| HAMP | AD-47050 | 155 | 14.55 | 1.46 | 35.51 | 0.33 | | |
| HAMP | AD-47062 | 157 | 13.42 | 1.10 | 45.34 | 3.82 | | |
| HAMP | AD-47056 | 157 | 23.31 | 0.44 | 46.02 | 0.80 | | |
| HAMP | AD-47068 | 160 | 24.68 | 0.67 | 56.12 | 4.66 | | |
| HAMP | AD-47033 | 161 | 11.56 | 4.54 | 36.94 | 0.19 | | |
| HAMP | AD-47074 | 161 | 9.99 | 1.07 | 44.47 | 0.95 | | |
| HAMP | AD-47039 | 162 | 63.29 | 2.38 | 80.39 | 15.70 | | |
| HAMP | AD-47045 | 162 | 86.89 | 5.22 | 96.60 | 14.33 | | |
| HAMP | AD-47057 | 242 | 66.74 | 2.06 | 82.90 | 10.89 | | |
| HAMP | AD-47051 | 242 | 72.68 | 0.12 | 86.34 | 3.07 | | |
| HAMP | AD-47063 | 253 | 26.21 | 0.40 | 58.94 | 7.25 | | |
| HAMP | AD-47069 | 258 | 30.01 | 3.26 | 41.02 | 3.03 | | |
| HAMP | AD-47075 | 261 | 30.80 | 2.74 | 75.66 | 1.48 | | |
| HAMP | AD-47034 | 275 | 54.15 | 10.01 | 75.48 | 16.26 | | |
| HAMP | AD-47046 | 276 | 13.55 | 0.80 | 30.18 | 6.37 | | |
| HAMP | AD-47040 | 276 | 18.09 | 3.87 | 40.15 | 14.54 | | |
| HAMP | AD-47058 | 279 | 36.00 | 4.98 | 64.23 | 1.93 | | |
| HAMP | AD-47070 | 280 | 12.74 | 1.13 | 34.84 | 9.02 | | |
| HAMP | AD-47064 | 280 | 17.08 | 0.13 | 49.50 | 0.21 | | |
| HAMP | AD-47076 | 281 | 12.07 | 1.81 | 36.35 | 5.58 | | |
| HAMP | AD-47035 | 282 | 31.01 | 7.32 | 61.60 | 1.15 | | |
| HAMP | AD-47041 | 283 | 16.92 | 0.64 | 39.03 | 10.75 | | |
| HAMP | AD-47053 | 284 | 10.31 | 0.77 | 23.40 | 7.24 | | |
| HAMP | AD-47047 | 284 | 12.12 | 0.18 | 30.96 | 7.74 | | |
| HAMP | AD-47059 | 285 | 20.79 | 0.79 | 45.23 | 6.52 | | |
| HAMP | AD-47071 | 286 | 15.36 | 1.48 | 36.67 | 8.67 | | |
| HAMP | AD-47065 | 286 | 19.45 | 0.16 | 53.77 | 19.91 | | |
| HAMP | AD-47077 | 287 | 9.85 | 0.40 | 45.43 | 2.39 | | |
| HAMP | AD-48208 | 288 | 9.71 | 4.88 | 14.16 | 3.25 | 40.26 | 4.14 |
| HAMP | AD-47042 | 288 | 9.47 | 2.61 | 24.02 | 11.39 | | |
| HAMP | AD-48202 | 288 | 11.49 | 3.71 | 27.05 | 3.20 | 69.29 | 1.70 |
| HAMP | AD-47036 | 288 | 10.22 | 1.87 | 38.40 | 8.79 | | |
| HAMP | AD-47048 | 290 | 38.00 | 2.44 | 80.14 | 9.40 | | |
| HAMP | AD-47054 | 290 | 46.82 | 5.24 | 87.19 | 6.81 | | |
| HAMP | AD-47005 | 291 | 34.54 | 2.08 | 63.87 | 11.34 | | |
| HAMP | AD-11436 | 291 | 43.37 | 7.53 | 74.23 | 14.15 | | |
| HAMP | AD-47066 | 295 | 37.84 | 6.67 | 66.36 | 3.03 | | |
| HAMP | AD-47060 | 295 | 52.68 | 4.93 | 83.68 | 16.47 | | |
| HAMP | AD-47072 | 299 | 74.58 | 22.86 | 117.51 | 7.68 | | |
| HAMP | AD-46988 | 307 | 39.46 | 7.63 | 78.38 | 1.82 | | |
| HAMP | AD-46994 | 309 | 91.00 | 6.12 | 100.96 | 9.30 | | |
| HAMP | AD-47000 | 310 | 42.88 | 7.35 | 65.34 | 6.09 | | |
| HAMP | AD-47006 | 313 | 27.81 | 0.36 | 71.03 | 9.01 | | |
| HAMP | AD-47011 | 314 | 24.50 | 4.38 | 63.98 | 14.14 | | |
| HAMP | AD-47016 | 322 | 65.73 | 3.26 | 90.84 | 9.34 | | |
| HAMP | AD-47021 | 347 | 80.76 | 0.51 | 86.40 | 9.24 | | |
| HAMP | AD-47026 | 348 | 71.64 | 5.09 | 81.58 | 5.61 | | |
| HAMP | AD-46989 | 349 | 90.45 | 10.46 | 99.05 | 11.53 | | |
| HAMP | AD-46995 | 350 | 20.68 | 3.39 | 75.89 | 9.25 | | |
| HAMP | AD-47001 | 351 | 74.47 | 1.50 | 80.49 | 21.50 | | |
| HAMP | AD-47012 | 352 | 71.82 | 13.01 | 84.03 | 5.63 | | |
| HAMP | AD-47007 | 352 | 82.28 | 15.46 | 89.63 | 9.85 | | |
| HAMP | AD-47017 | 354 | 66.26 | 8.83 | 100.80 | 21.89 | | |
| HAMP | AD-47022 | 355 | 63.73 | 4.49 | 87.39 | 9.12 | | |
| HAMP | AD-47027 | 355 | 68.87 | 6.64 | 108.08 | 32.59 | | |
| HAMP | AD-46996 | 355 | 37.91 | 1.83 | 48.04 | 6.32 | | |
| HAMP | AD-46990 | 356 | 41.87 | 4.92 | 54.43 | 6.70 | | |
| HAMP | AD-47002 | 357 | 16.19 | 0.33 | 42.98 | 3.19 | | |
| HAMP | AD-47013 | 358 | 22.95 | 0.97 | 44.27 | 7.76 | | |
| HAMP | AD-47008 | 358 | 20.38 | 2.71 | 50.46 | 16.50 | | |
| HAMP | AD-47023 | 359 | 77.40 | 10.19 | 95.51 | 9.29 | | |
| HAMP | AD-47018 | 359 | 95.24 | 14.37 | 97.19 | 8.72 | | |
| HAMP | AD-47028 | 363 | 28.25 | 2.86 | 62.93 | 4.48 | | |
| HAMP | AD-46991 | 365 | 15.53 | 2.49 | 29.41 | 0.30 | | |

TABLE 8-continued

HAMP single dose screen (Modified Duplexes, Human Endogenous)

| | | | 10 nM | | 0.1 nM | | 0.01 nM | |
|---|---|---|---|---|---|---|---|---|
| Target | Duplex ID | Start Position | Avg | SD | Avg | SD | Avg | SD |
| HAMP | AD-46997 | 366 | 31.51 | 3.85 | 48.07 | 6.21 | | |
| HAMP | AD-47003 | 369 | 9.85 | 2.64 | 34.31 | 6.01 | | |
| HAMP | AD-47009 | 370 | 6.69 | 1.11 | 24.11 | 3.57 | | |
| HAMP | AD-47014 | 373 | 55.85 | 3.19 | 60.89 | 10.51 | | |
| HAMP | AD-47019 | 375 | 28.54 | 1.87 | 49.45 | 14.83 | | |
| HAMP | AD-48214 | 376 | 12.63 | 3.25 | 16.69 | 1.38 | 29.21 | 0.40 |
| HAMP | AD-48219 | 376 | 15.92 | 0.02 | 18.92 | 0.48 | 33.17 | 2.16 |
| HAMP | AD-47024 | 376 | 19.61 | 1.81 | 42.20 | 5.93 | | |
| HAMP | AD-48224 | 379 | 22.20 | 5.60 | 33.45 | 1.62 | 52.72 | 1.81 |
| HAMP | AD-48187 | 379 | 25.57 | 5.25 | 46.92 | 0.04 | 73.94 | 0.20 |
| HAMP | AD-47029 | 379 | 24.31 | 0.26 | 47.37 | 6.54 | | |
| HAMP | AD-48192 | 379 | 19.69 | 0.78 | 55.32 | 4.62 | 88.04 | 0.76 |
| HAMP | AD-46992 | 380 | 23.41 | 3.32 | 37.52 | 4.13 | | |
| HAMP | AD-46998 | 381 | 26.55 | 2.19 | 49.95 | 0.87 | | |
| HAMP | AD-48137 | 382 | 8.66 | 0.33 | 11.24 | 1.02 | 26.89 | 1.08 |
| HAMP | AD-48196 | 382 | 6.92 | 3.59 | 11.81 | 1.33 | 22.33 | 0.98 |
| HAMP | AD-48195 | 382 | 6.10 | 2.66 | 12.50 | 3.26 | 26.60 | 1.17 |
| HAMP | AD-48201 | 382 | 12.95 | 1.61 | 13.01 | 2.07 | 25.66 | 6.95 |
| HAMP | AD-48207 | 382 | 7.91 | 2.77 | 13.17 | 0.62 | 21.22 | 1.42 |
| HAMP | AD-48159 | 382 | 15.26 | 0.13 | 13.59 | 1.45 | 28.89 | 4.67 |
| HAMP | AD-48147 | 382 | 14.28 | 0.17 | 13.65 | 0.38 | 25.68 | 3.81 |
| HAMP | AD-48161 | 382 | 9.61 | 3.69 | 13.77 | 1.67 | 22.95 | 0.59 |
| HAMP | AD-48172 | 382 | 11.67 | 0.41 | 13.98 | 1.39 | 27.28 | 5.22 |
| HAMP | AD-48156 | 382 | 12.14 | 0.96 | 14.06 | 1.75 | 28.85 | 2.18 |
| HAMP | AD-48195 | 382 | 6.81 | 0.62 | 14.14 | 0.37 | 27.99 | 0.61 |
| HAMP | AD-48136 | 382 | 10.81 | 4.42 | 14.16 | 1.41 | 29.89 | 1.13 |
| HAMP | AD-48166 | 382 | 8.74 | 2.41 | 14.22 | 0.42 | 25.21 | 2.09 |
| HAMP | AD-48213 | 382 | 8.35 | 1.61 | 14.49 | 3.71 | 22.38 | 0.33 |
| HAMP | AD-48173 | 382 | 12.84 | 3.32 | 14.51 | 0.96 | 27.87 | 5.30 |
| HAMP | AD-48154 | 382 | 9.93 | 2.07 | 14.80 | 0.75 | 23.47 | 0.94 |
| HAMP | AD-48141 | 382 | 12.73 | 2.32 | 14.92 | 0.32 | 26.97 | 5.76 |
| HAMP | AD-48216 | 382 | 10.39 | 0.95 | 15.18 | 2.11 | 22.38 | 1.02 |
| HAMP | AD-48180 | 382 | 7.71 | 0.47 | 15.20 | 1.30 | 29.01 | 1.11 |
| HAMP | AD-48143 | 382 | 7.00 | 2.73 | 15.44 | 1.88 | 24.35 | 2.09 |
| HAMP | AD-48142 | 382 | 10.10 | 3.42 | 15.50 | 0.90 | 25.84 | 2.08 |
| HAMP | AD-48221 | 382 | 9.54 | 1.43 | 15.56 | 0.24 | 23.59 | 1.06 |
| HAMP | AD-48171 | 382 | 13.46 | 5.06 | 15.67 | 0.63 | 26.44 | 6.58 |
| HAMP | AD-48145 | 382 | 10.87 | 0.68 | 15.70 | 2.69 | 28.65 | 2.93 |
| HAMP | AD-48160 | 382 | 10.77 | 0.26 | 15.74 | 1.29 | 28.12 | 4.11 |
| HAMP | AD-48144 | 382 | 9.88 | 0.46 | 15.75 | 0.94 | 33.60 | 0.84 |
| HAMP | AD-48167 | 382 | 10.83 | 1.48 | 15.87 | 3.03 | 24.90 | 2.15 |
| HAMP | AD-48177 | 382 | 15.05 | 2.15 | 15.87 | 0.86 | 28.68 | 8.05 |
| HAMP | AD-48153 | 382 | 12.07 | 5.83 | 15.92 | 1.04 | 31.19 | 3.85 |
| HAMP | AD-48178 | 382 | 11.02 | 0.05 | 16.06 | 0.45 | 27.12 | 2.27 |
| HAMP | AD-48155 | 382 | 12.92 | 0.25 | 16.32 | 4.70 | 27.64 | 0.32 |
| HAMP | AD-48174 | 382 | 11.50 | 2.09 | 16.39 | 0.74 | 27.90 | 4.46 |
| HAMP | AD-48205 | 382 | 7.46 | 7.62 | 16.39 | 2.29 | 24.17 | 1.56 |
| HAMP | AD-48179 | 382 | 10.80 | 3.42 | 16.50 | 0.71 | 27.82 | 3.57 |
| HAMP | AD-48168 | 382 | 12.14 | 4.14 | 16.63 | 1.58 | 27.25 | 1.24 |
| HAMP | AD-48149 | 382 | 10.42 | 0.41 | 16.71 | 3.88 | 28.30 | 1.91 |
| HAMP | AD-48211 | 382 | 9.46 | 4.30 | 16.80 | 1.44 | 25.08 | 0.20 |
| HAMP | AD-48200 | 382 | 9.05 | 1.30 | 16.97 | 2.20 | 28.99 | 0.38 |
| HAMP | AD-48188 | 382 | 11.09 | 3.14 | 16.99 | 2.41 | 32.42 | 1.58 |
| HAMP | AD-48183 | 382 | 9.79 | 11.87 | 17.20 | 0.54 | 42.02 | 0.63 |
| HAMP | AD-48150 | 382 | 9.99 | 8.19 | 17.30 | 2.27 | 35.68 | 0.32 |
| HAMP | AD-48162 | 382 | 8.48 | 2.96 | 17.38 | 1.26 | 29.63 | 0.85 |
| HAMP | AD-48139 | 382 | 10.35 | 1.92 | 17.78 | 0.51 | 36.00 | 2.79 |
| HAMP | AD-9942 | 382 | 8.96 | 1.21 | 18.03 | 1.85 | 30.09 | 0.13 |
| HAMP | AD-48138 | 382 | 10.06 | 2.32 | 18.04 | 1.88 | 26.97 | 1.56 |
| HAMP | AD-11459 | 382 | 7.07 | 0.09 | 18.93 | 3.13 | | |
| HAMP | AD-48189 | 382 | 8.39 | 0.33 | 19.16 | 0.02 | 26.30 | 0.33 |
| HAMP | AD-48148 | 382 | 10.68 | 1.22 | 19.23 | 3.07 | 32.33 | 1.11 |
| HAMP | AD-48215 | 382 | 12.87 | 3.87 | 19.50 | 0.69 | 35.59 | 3.70 |
| HAMP | AD-48218 | 382 | 12.77 | 1.57 | 22.32 | 2.42 | 48.01 | 5.44 |
| HAMP | AD-48135 | 382 | 13.43 | 1.45 | 26.06 | 4.80 | 57.92 | 1.12 |
| HAMP | AD-47004 | 382 | 10.04 | 1.61 | 26.68 | 3.90 | | |
| HAMP | AD-48194 | 382 | 13.40 | 1.06 | 27.15 | 1.41 | 44.44 | 2.80 |
| HAMP | AD-48197 | 382 | 13.40 | 6.22 | 27.28 | 1.85 | 47.77 | 5.73 |
| HAMP | AD-11459 | 382 | 14.32 | 0.61 | 28.20 | 2.18 | 50.13 | 0.65 |
| HAMP | AD-48164 | 382 | 16.52 | 2.52 | 28.92 | 3.09 | 55.94 | 0.41 |
| HAMP | AD-48158 | 382 | 11.63 | 2.57 | 29.78 | 1.47 | 51.55 | 0.47 |
| HAMP | AD-48204 | 382 | 11.53 | 13.16 | 29.90 | 1.81 | 68.66 | 2.16 |
| HAMP | AD-48181 | 382 | 11.31 | 3.03 | 30.04 | 2.07 | 65.39 | 3.38 |
| HAMP | AD-48223 | 382 | 12.35 | 5.46 | 30.39 | 3.74 | 60.92 | 1.91 |

TABLE 8-continued

HAMP single dose screen (Modified Duplexes, Human Endogenous)

| Target | Duplex ID | Start Position | 10 nM Avg | 10 nM SD | 0.1 nM Avg | 0.1 nM SD | 0.01 nM Avg | 0.01 nM SD |
|---|---|---|---|---|---|---|---|---|
| HAMP | AD-48190 | 382 | 10.09 | 1.16 | 30.78 | 0.29 | 61.44 | 0.86 |
| HAMP | AD-48163 | 382 | 13.43 | 2.71 | 31.64 | 4.03 | 60.73 | 1.22 |
| HAMP | AD-48140 | 382 | 11.77 | 2.88 | 31.73 | 2.21 | 57.59 | 0.57 |
| HAMP | AD-48169 | 382 | 12.50 | 0.13 | 32.00 | 4.43 | 60.20 | 3.22 |
| HAMP | AD-48220 | 382 | 15.52 | 3.73 | 32.05 | 1.48 | 58.71 | 2.57 |
| HAMP | AD-48184 | 382 | 13.23 | 0.16 | 33.25 | 3.63 | 56.78 | 2.43 |
| HAMP | AD-48176 | 382 | 16.68 | 3.88 | 34.04 | 1.12 | 68.51 | 2.16 |
| HAMP | AD-48175 | 382 | 13.60 | 9.49 | 34.34 | 2.07 | 63.89 | 2.17 |
| HAMP | AD-48146 | 382 | 13.16 | 4.10 | 35.07 | 0.23 | 61.14 | 1.09 |
| HAMP | AD-48182 | 382 | 13.71 | 8.96 | 36.24 | 0.98 | 71.73 | 0.19 |
| HAMP | AD-48199 | 382 | 11.16 | 0.69 | 36.33 | 1.26 | 66.19 | 0.94 |
| HAMP | AD-48157 | 382 | 11.27 | 0.12 | 36.54 | 2.61 | 71.05 | 0.88 |
| HAMP | AD-48206 | 382 | 10.51 | 2.71 | 36.79 | 4.47 | 61.74 | 0.21 |
| HAMP | AD-48193 | 382 | 13.00 | 3.25 | 37.58 | 2.12 | 73.07 | 0.26 |
| HAMP | AD-48152 | 382 | 21.49 | 5.83 | 39.17 | 6.15 | 68.81 | 10.01 |
| HAMP | AD-48151 | 382 | 13.62 | 10.83 | 39.31 | 6.55 | 66.68 | 1.47 |
| HAMP | AD-48170 | 382 | 14.54 | 2.27 | 47.27 | 4.01 | 70.43 | 2.22 |
| HAMP | AD-47010 | 383 | 41.47 | 1.29 | 64.00 | 4.87 | | |
| HAMP | AD-48222 | 385 | 9.49 | 0.13 | 10.82 | 1.20 | 18.78 | 2.86 |
| HAMP | AD-48217 | 385 | 14.39 | 3.84 | 14.26 | 0.55 | 19.91 | 0.71 |
| HAMP | AD-48185 | 385 | 14.22 | 4.44 | 18.35 | 1.29 | 37.50 | 0.03 |
| HAMP | AD-48212 | 385 | 20.56 | 4.86 | 22.61 | 3.43 | 26.13 | 0.41 |
| HAMP | AD-48198 | 396 | 8.31 | 23.06 | 13.10 | 3.95 | 50.72 | 1.39 |
| HAMP | AD-48209 | 396 | 8.76 | 5.65 | 14.85 | 3.44 | 33.81 | 2.06 |
| HAMP | AD-48203 | 396 | 9.38 | 2.78 | 15.08 | 2.34 | 35.67 | 2.38 |
| HAMP | AD-47015 | 396 | 16.43 | 2.26 | 30.67 | 1.14 | | |
| HAMP | AD-47020 | 398 | 50.18 | 1.59 | 68.91 | 17.54 | | |
| HAMP | AD-47025 | 399 | 13.04 | 0.87 | 19.74 | 1.31 | | |
| HAMP | AD-47030 | 402 | 5.12 | 0.55 | 12.72 | 0.67 | | |
| HAMP | AD-46993 | 403 | 5.82 | 2.21 | 12.55 | 1.15 | | |
| HAMP | AD-46999 | 407 | 11.34 | 1.35 | 15.21 | 1.41 | | |

Data are expressed as percent of mock.

TABLE 9

HAMP dose-response (Dual Luciferase, HepG2, Cyno primary hepatocytes; Unmodified & Modified duplexes)

| Target | Duplex ID | Start position | Modification status | IC50 (nM) Luc | IC50 (nM) HepG2 | IC50 (nM) Cyno |
|---|---|---|---|---|---|---|
| HAMP | AD-29939 | 74 | Modified | 0.288 | | |
| HAMP | AD-45700 | 74 | Modified | | 0.752 | |
| HAMP | AD-29940 | 75 | Modified | 0.929 | | |
| HAMP | AD-29943 | 152 | Modified | 0.567 | | |
| HAMP | AD-29950 | 232 | Modified | 1.527 | | |
| HAMP | AD-29951 | 234 | Modified | 0.408 | | |
| HAMP | AD-30017 | 241 | Modified | 0.163 | | |
| HAMP | AD-30018 | 242 | Modified | 0.517 | | |
| HAMP | AD-29959 | 267 | Modified | 0.147 | | |
| HAMP | AD-29963 | 276 | Modified | 0.155 | | |
| HAMP | AD-45722 | 276 | Modified | | 0.299 | |
| HAMP | AD-29965 | 281 | Modified | 1.149 | | |
| HAMP | AD-30020 | 283 | Modified | 39.122 | | |
| HAMP | AD-30021 | 284 | Modified | 0.308 | | |
| HAMP | AD-11441 | 285 | Modified | 0.042 | 0.135 | 0.027 |
| HAMP | AD-11458 | 285 | Modified | 0.358 | | |
| HAMP | AD-45729 | 288 | Modified | | 0.068 | 0.016 |
| HAMP | AD-48208 | 288 | Modified | | 0.012 | 0.016 |
| HAMP | AD-11436 | 291 | Modified | 0.054 | >10 nM | |
| HAMP | AD-11453 | 291 | Modified | 0.134 | | |
| HAMP | AD-29971 | 291 | Modified | 0.108 | | |
| HAMP | AD-29972 | 294 | Modified | 0.154 | | |
| HAMP | AD-29974 | 300 | Modified | 0.137 | | |
| HAMP | AD-29975 | 301 | Modified | 1.392 | | |
| HAMP | AD-45081 | 309 | Modified | | >10 nM | |
| HAMP | AD-45087 | 310 | Modified | | >10 nM | |
| HAMP | AD-45093 | 313 | Modified | | >10 nM | |
| HAMP | AD-29979 | 352 | Modified | | >10 nM | |
| HAMP | AD-45750 | 352 | Modified | | 1.558 | |
| HAMP | AD-45755 | 352 | Modified | | 0.296 | |
| HAMP | AD-45725 | 355 | Modified | | >10 nM | |
| HAMP | AD-29981 | 357 | Modified | | >10 nM | |
| HAMP | AD-45761 | 359 | Modified | | >10 nM | |
| HAMP | AD-45377 | 364 | Modified | | >10 nM | |
| HAMP | AD-29982 | 365 | Modified | | 1.723 | |
| HAMP | AD-29983 | 366 | Modified | | >10 nM | |
| HAMP | AD-47099 | 370 | Unmodified | | 0.017 | 0.081 |
| HAMP | AD-47114 | 376 | Unmodified | | 0.008 | 0.036 |
| HAMP | AD-48214 | 376 | Modified | | 0.008 | 1.575 |
| HAMP | AD-47119 | 379 | Unmodified | | 0.004 | 0.040 |
| HAMP | AD-47088 | 381 | Unmodified | | 0.007 | >10 nM |
| HAMP | AD-11442 | 382 | Modified | | 0.028 | 0.010 |
| HAMP | AD-11459 | 382 | Unmodified | | 0.038 | 0.045 |
| HAMP | AD-45062 | 382 | Modified | | 0.088 | 0.030 |
| HAMP | AD-47094 | 382 | Unmodified | | 0.005 | 0.039 |
| HAMP | AD-48141 | 382 | Modified | | 0.004 | 0.023 |
| HAMP | AD-48147 | 382 | Modified | | 0.007 | 0.008 |
| HAMP | AD-48154 | 382 | Modified | | 0.006 | 0.019 |
| HAMP | AD-48189 | 382 | Modified | | 0.005 | 0.145 |
| HAMP | AD-48195 | 382 | Modified | | 0.011 | 0.009 |
| HAMP | AD-48196 | 382 | Modified | | 0.017 | 0.031 |
| HAMP | AD-48201 | 382 | Modified | | 0.007 | 0.009 |
| HAMP | AD-48205 | 382 | Modified | | 0.014 | 0.022 |
| HAMP | AD-48207 | 382 | Modified | | 0.007 | 0.017 |
| HAMP | AD-48213 | 382 | Modified | | 0.009 | 0.027 |
| HAMP | AD-48216 | 382 | Modified | | 0.014 | 0.035 |
| HAMP | AD-47100 | 383 | Unmodified | | 0.007 | 0.172 |
| HAMP | AD-48217 | 385 | Modified | | 0.028 | 0.021 |

TABLE 9-continued

HAMP dose-response (Dual Luciferase, HepG2, Cyno primary hepatocytes; Unmodified & Modified duplexes)

| Target | Duplex ID | Start position | Modification status | IC50 (nM) Luc | HepG2 | Cyno |
|---|---|---|---|---|---|---|
| HAMP | AD-47105 | 396 | Unmodified | 0.005 | | >10 nM |
| HAMP | AD-48209 | 396 | Modified | 0.013 | | >10 nM |
| HAMP | AD-47115 | 399 | Unmodified | 0.007 | | >10 nM |
| HAMP | AD-47030 | 402 | Modified | 0.015 | | >10 nM |
| HAMP | AD-47120 | 402 | Unmodified | 0.006 | | >10 nM |
| HAMP | AD-46993 | 403 | Modified | 0.015 | | >10 nM |
| HAMP | AD-47083 | 403 | Unmodified | 0.007 | | >10 nM |
| HAMP | AD-46999 | 407 | Modified | 0.011 | | >10 nM |

TABLE 10A

Tables 10A and 10B: Secondary Target sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HFE2 | AD-47391 | 177 | A-98855.1 | AGAGuAGGGAAucAuGGcudTsdT | 31 | A-98856.1 | AGCcAUGAUUCCCuACUCUdTsdT | 33 |
| HFE2 | AD-47397 | 193 | A-98857.1 | GcuGGAGAAuuGGAuAGcAdTsdT | 708 | A-98858.1 | UGCuAUCcAAUUCUCcAGCdTsdT | 753 |
| HFE2 | AD-47403 | 195 | A-98859.1 | uGGAGAAuuGGAuAGcAGAdTsdT | 709 | A-98860.1 | UCUGCuAUCcAAUUCUCcAdTsdT | 754 |
| HFE2 | AD-47409 | 199 | A-98861.1 | GAAuuGGAuAGcAGAGuAAdTsdT | 710 | A-98862.1 | UuACUCUGCuAUCcAAUUCdTsdT | 755 |
| HFE2 | AD-47415 | 200 | A-98863.1 | AAuuGGAuAGcAGAGuAAudTsdT | 711 | A-98864.1 | AUuACUCUGCuAUCcAAUUdTsdT | 756 |
| HFE2 | AD-47421 | 206 | A-98865.1 | AuAGcAGAGuAAuGuuuGAdTsdT | 712 | A-98866.1 | UcAAAcAUuACUCUGCuAUdTsdT | 757 |
| HFE2 | AD-47427 | 211 | A-98867.1 | AGAGuAAuGuuuGAccucudTsdT | 713 | A-98868.1 | AGAGGUcAAAcAUuACUCUdTsdT | 758 |
| HFE2 | AD-47433 | 244 | A-98869.1 | ucAuAuuuAAGAAcAuGcAdTsdT | 714 | A-98870.1 | UGcAUGUUCUuAAAAuAUGAdTsdT | 759 |
| HFE2 | AD-47392 | 257 | A-98871.1 | cAuGcAGGAAuGcAuuGAudTsdT | 715 | A-98872.1 | AUcAAUGcAUUCCUGcAUGdTsdT | 760 |
| HFE2 | AD-47398 | 261 | A-98873.1 | cAGGAAuGcAuuGAucAGAdTsdT | 716 | A-98874.1 | UCUGAUcAAUGcAUUCCUGdTsdT | 761 |
| HFE2 | AD-47404 | 290 | A-98875.1 | GGcuGAGGuGGAuAAucuudTsdT | 717 | A-98876.1 | AAGAUuAUCcACCUcAGCCdTsdT | 762 |
| HFE2 | AD-47410 | 360 | A-98877.1 | uccAGuuuGucGAuucAAAdTsdT | 718 | A-98878.1 | UUUGAAUCGAcAAACUGGAdTsdT | 763 |
| HFE2 | AD-47416 | 367 | A-98879.1 | uGucGAuucAAAcuGcuAAdTsdT | 719 | A-98880.1 | UuAGcAGUUUGAAUCGAcAdTsdT | 764 |
| HFE2 | AD-47422 | 404 | A-98881.1 | GAuccAAGcuGccuAcAuudTsdT | 720 | A-98882.1 | AAUGuAGGcAGCUUGGAUCdTsdT | 765 |
| HFE2 | AD-47428 | 415 | A-98883.1 | ccuAcAuuGGcAcAAcuAudTsdT | 721 | A-98884.1 | AuAGUUGUGCcAAUGuAGGdTsdT | 766 |
| HFE2 | AD-47434 | 417 | A-98885.1 | uAcAuuGGcAcAAcuAuAAdTsdT | 722 | A-98886.1 | UuAuAGUUGUGCcAAUGuAdTsdT | 767 |
| HFE2 | AD-47393 | 472 | A-98887.1 | ucAAGGuAGcAGAGGAuGudTsdT | 723 | A-98888.1 | AcAUCCUCUGCuACCUUGAdTsdT | 768 |
| HFE2 | AD-47399 | 585 | A-98889.1 | GGAGcuAuAAccAuuGAudTsdT | 724 | A-98890.1 | uAUcAAUGGUuAuAGCUCCdTsdT | 769 |
| HFE2 | AD-47405 | 587 | A-98891.1 | AGcuAuAAccAuuGAuAcudTsdT | 725 | A-98892.1 | AGuAUcAAUGGUuAuAGCUdTsdT | 770 |

TABLE 10A-continued

Tables 10A and 10B: Secondary Target sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HFE2 | AD-47417 | 638 | A-98895.1 | GGAAGAuGcuuAcuuccAudTsdT | 726 | A-98896.1 | AUGGAAGuAAGcAUCUUCCdTsdT | 771 |
| HFE2 | AD-47423 | 642 | A-98897.1 | GAuGcuuAcuuccAuuccudTsdT | 727 | A-98898.1 | AGGAAUGGAAGuAAGcAUCdTsdT | 772 |
| HFE2 | AD-47429 | 646 | A-98899.1 | cuuAcuuccAuuccuGuGudTsdT | 728 | A-98900.1 | AcAcAGGAAUGGAAGuAAGdTsdT | 773 |
| HFE2 | AD-47435 | 656 | A-98901.1 | uuccuGuGucuuuGAuGuudTsdT | 729 | A-98902.1 | AAcAUcAAAGAcAcAGGAAdTsdT | 774 |
| HFE2 | AD-47394 | 657 | A-98903.1 | uccuGuGucuuuGAuGuuudTsdT | 730 | A-98904.1 | AAAcAUcAAAGAcAcAGGAdTsdT | 775 |
| HFE2 | AD-47400 | 678 | A-98905.1 | AuuucuGGuGAucccAAcudTsdT | 731 | A-98906.1 | AGUUGGGAUcAccAGAAAUdTsdT | 776 |
| HFE2 | AD-47406 | 1121 | A-98907.1 | ccAuuuAcuGcAGAuuucAdTsdT | 732 | A-98908.1 | UGAAAUCUGcAGuAAAUGGdTsdT | 777 |
| HFE2 | AD-47412 | 1151 | A-98909.1 | uuAGAGGucAuGAAGGuuudTsdT | 733 | A-98910.1 | AAACCUUcAUGACCUCuAAdTsdT | 778 |
| HFE2 | AD-47418 | 1152 | A-98911.1 | uAGAGGucAuGAAGGuuuudTsdT | 734 | A-98912.1 | AAAACCUUcAUGACCUCuAdTsdT | 779 |
| HFE2 | AD-47424 | 1203 | A-98913.1 | uuAAGAGGcAAGAGcuGAAdTsdT | 735 | A-98914.1 | UUcAGCUCUUGCCUCUuAAdTsdT | 780 |
| HFE2 | AD-47430 | 1228 | A-98915.1 | AGAcAuGAucAuuAGccAudTsdT | 736 | A-98916.1 | AUGGCuAAUGAUcAUGUCUdTsdT | 781 |
| HFE2 | AD-47436 | 1230 | A-98917.1 | AcAuGAucAuuAGccAuAAdTsdT | 737 | A-98918.1 | UuAUGGCuAAUGAUcAUGUdTsdT | 782 |
| HFE2 | AD-47395 | 1233 | A-98919.1 | uGAucAuuAGccAuAAGAAdTsdT | 738 | A-98920.1 | UUCUuAUGGCuAAUGAUcAdTsdT | 783 |
| HFE2 | AD-47401 | 1272 | A-98921.1 | AuuAGGGAAAGAAGucuAudTsdT | 739 | A-98922.1 | AuAGACUUCUUUCCCuAAUdTsdT | 784 |
| HFE2 | AD-47407 | 1273 | A-98923.1 | uuAGGGAAAGAAGucuAuudTsdT | 740 | A-98924.1 | AAuAGACUUCUUUCCCuAAdTsdT | 785 |
| HFE2 | AD-51740 | 1273 | A-107281.4 | uuAGGGAAAGAAGuCuAuUdTsdT | 740 | A-107275.3 | AAuAGACUUCUUUCCCuAadTsdT | 785 |
| HFE2 | AD-51747 | 1273 | A-107280.6 | uuAGGGAAAGAAGucuAuUdTsdT | 740 | A-107277.2 | AAuAGACUuCUuUCCuCuAdTsdT | 785 |
| HFE2 | AD-51744 | 1273 | A-107281.5 | uuAGGGAAAGAAGuCuAuUdTsdT | 740 | A-107276.3 | AAuAGACUuCUuUCCCuAdTsdT | 785 |
| HFE2 | AD-51731 | 1273 | A-107280.2 | uuAGGGAAAGAAGucuAuUdTsdT | 740 | A-107273.2 | AAuAGACUUCUuUCCCuAdTsdT | 785 |
| HFE2 | AD-51736 | 1273 | A-107281.3 | uuAGGGAAAGAAGuCuAuUdTsdT | 740 | A-107274.3 | AAuAGACUUCUUUCCuAdTsdT | 785 |
| HFE2 | AD-51732 | 1273 | A-107281.2 | uuAGGGAAAGAAGuCuAuUdTsdT | 740 | A-107273.3 | AAuAGACUUCUuUCCCuAdTsdT | 785 |
| HFE2 | AD-51734 | 1273 | A-98923.4 | uuAGGGAAAGAAGucuAuudTsdT | 740 | A-107274.1 | AAuAGACUUCUUUCCuAdTsdT | 785 |
| HFE2 | AD-51748 | 1273 | A-107281.6 | uuAGGGAAAGAAGuCuAuUdTsdT | 740 | A-107277.3 | AAuAGACUuCUuUCCuAdTsdT | 785 |
| HFE2 | AD-51735 | 1273 | A-107280.3 | uuAGGGAAAGAAGucuAuUdTsdT | 740 | A-107274.2 | AAuAGACUUCUUUCCuAdTsdT | 785 |
| HFE2 | AD-51749 | 1273 | A-107282.6 | uuAgGGAAAGAAGuCuAuUdTsdT | 740 | A-107277.4 | AAuAGACUuCUuUCCuAdTsdT | 785 |

TABLE 10A-continued

Tables 10A and 10B: Secondary Target sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HFE2 | AD-51752 | 1273 | A-107281.7 | uuAGGGAAAGAAGuCuAuUdTsdT | 740 | A-107278.3 | AAuAGACUuCUuUCcCuAadTsdT | 785 |
| HFE2 | AD-51738 | 1273 | A-98923.5 | uuAGGGAAAGAAGucuAuudTsdT | 740 | A-107275.1 | AAuAGACUUCUUUCCCuAadTsdT | 785 |
| HFE2 | AD-51730 | 1273 | A-98923.3 | uuAGGGAAAGAAGucuAuudTsdT | 740 | A-107273.1 | AAuAGACUUCUuUCCCuAAdTsdT | 785 |
| HFE2 | AD-51745 | 1273 | A-107282.5 | uuAgGGAAAGAAGuCuAuUdTsdT | 740 | A-107276.4 | AAuAGACUuCUuUCCCuAAdTsdT | 785 |
| HFE2 | AD-51737 | 1273 | A-107282.3 | uuAgGGAAAGAAGuCuAuUdTsdT | 740 | A-107274.4 | AAuAGACUUCUUUCCuAAdTsdT | 785 |
| HFE2 | AD-51743 | 1273 | A-107280.5 | uuAGGGAAAGAAGucuAuUdTsdT | 740 | A-107276.2 | AAuAGACUuCUuUCCCuAAdTsdT | 785 |
| HFE2 | AD-51751 | 1273 | A-107280.7 | uuAGGGAAAGAAGucuAuUdTsdT | 740 | A-107278.2 | AAuAGACUuCUuUCcCUAadTsdT | 785 |
| HFE2 | AD-51750 | 1273 | A-98923.8 | uuAGGGAAAGAAGucuAuudTsdT | 740 | A-107278.1 | AAuAGACUuCUuUCcCuAadTsdT | 785 |
| HFE2 | AD-51741 | 1273 | A-107282.4 | uuAgGGAAAGAAGuCuAuUdTsdT | 740 | A-107275.4 | AAuAGACUUCUuUCCCuAadTsdT | 785 |
| HFE2 | AD-51742 | 1273 | A-98923.6 | uuAGGGAAAGAAGucuAuudTsdT | 740 | A-107276.1 | AAuAGACUuCUuUCCCuAAdTsdT | 785 |
| HFE2 | AD-51733 | 1273 | A-107082.2 | uuAgGGAAAGAAGuCuAuUdTsdT | 740 | A-107273.4 | AAuAGACUUCUuUCCCuAAdTsdT | 785 |
| HFE2 | AD-51755 | 1273 | A-107280.8 | uuAGGGAAAGAAGucuAuUdTsdT | 740 | A-107279.2 | AAUAGACUuCUuUCcCuAadTsdT | 785 |
| HFE2 | AD-51756 | 1273 | A-107281.8 | uuAGGGAAAGAAGuCuAuUdTsdT | 740 | A-107279.3 | AAUAGACUuCUuUCcCuAadTsdT | 785 |
| HFE2 | AD-51728 | 1273 | A-107281.1 | uuAGGGAAAGAAGuCuAuUdTsdT | 740 | A-107272.3 | AAuAGACUuCUUUCCCuAAdTsdT | 785 |
| HFE2 | AD-51729 | 1273 | A-107282.1 | uuAgGGAAAGAAGuCuAuUdTsdT | 740 | A-107272.4 | AAuAGACUuCUUUCCCuAAdTsdT | 785 |
| HFE2 | AD-51726 | 1273 | A-98923.2 | uuAGGGAAAGAAGucuAuudTsdT | 740 | A-107272.1 | AAuAGACUuCUUUCCCuAAdTsdT | 785 |
| HFE2 | AD-51746 | 1273 | A-98923.7 | uuAGGGAAAGAAGucuAuudTsdT | 740 | A-107277.1 | AAuAGACUuCUuUCcCuAAdTsdT | 785 |
| HFE2 | AD-51757 | 1273 | A-107282.8 | uuAgGGAAAGAAGuCuAuUdTsdT | 740 | A-107279.4 | AAUAGACUuCUuUCcCuAadTsdT | 785 |
| HFE2 | AD-51727 | 1273 | A-107280.1 | uuAGGGAAAGAAGucuAuUdTsdT | 740 | A-107272.2 | AAuAGACUuCUUUCCCuAAdTsdT | 785 |
| HFE2 | AD-51753 | 1273 | A-107282.7 | uuAgGGAAAGAAGuCuAuUdTsdT | 740 | A-107278.4 | AAuAGACUuCUuUCcCuAadTsdT | 785 |
| HFE2 | AD-51754 | 1273 | A-98923.9 | uuAGGGAAAGAAGucuAuudTsdT | 740 | A-107279.1 | AAUAGACUuCUuUCcCuAadTsdT | 785 |
| HFE2 | AD-51739 | 1273 | A-107280.4 | uuAGGGAAAGAAGucuAuUdTsdT | 740 | A-107275.2 | AAuAGACUUCUUUCCCuAadTsdT | 785 |
| HFE2 | AD-47413 | 1274 | A-98925.1 | uAGGGAAAGAAGucuAuuudTsdT | 741 | A-98926.1 | AAAuGACUUCUUUCCCuAdTsdT | 786 |
| HFE2 | AD-47419 | 1279 | A-98927.1 | AAAGAAGucuAuuuGAuGAdTsdT | 742 | A-98928.1 | UcAUcAAAuAGACUUCUUUdTsdT | 787 |
| HFE2 | AD-47425 | 1280 | A-98929.1 | AAGAAGucuAuuuGAuGAAdTsdT | 743 | A-98930.1 | UUcAUcAAAuAGACUUCUUdTsdT | 788 |

TABLE 10A-continued

Tables 10A and 10B: Secondary Target sequences

| Target | Duplex ID | Start Position | Sense Name | Sense Sequence | SEQ ID NO | Antisense Name | Antisense Sequence | SEQ ID NO |
|---|---|---|---|---|---|---|---|---|
| HFE2 | AD-47431 | 1303 | A-98931.1 | uGuGuGuAAGGuAuGuucudTsdT | 744 | A-98932.1 | AGAAcAuACCUuAcAcAcAdTsdT | 789 |
| HFE2 | AD-47437 | 1366 | A-98933.1 | GuGAAGGGAGucucuGcuudTsdT | 745 | A-98934.1 | AAGcAGAGACUCCCUUcACdTsdT | 790 |
| HFE2 | AD-47396 | 1367 | A-98935.1 | uGAAGGGAGucucuGcuuudTsdT | 746 | A-98936.1 | AAAGcAGAGACUCCCUUcAdTsdT | 791 |
| HFE2 | AD-47402 | 1396 | A-98937.1 | cAcAGGuAGGAcAGAAGuAdTsdT | 747 | A-98938.1 | uACUUCUGUCCuACCUGUGdTsdT | 792 |
| HFE2 | AD-47408 | 1397 | A-98939.1 | AcAGGuAGGAcAGAAGuAudTsdT | 748 | A-98940.1 | AuACUUCUGUCCuACCUGUdTsdT | 793 |
| HFE2 | AD-47414 | 1399 | A-98941.1 | AGGuAGGAcAGAAGuAucAdTsdT | 749 | A-98942.1 | UGAuACUUCUGUCCuACCUdTsdT | 794 |
| HFE2 | AD-47420 | 1400 | A-98943.1 | GGuAGGAcAGAAGuAucAudTsdT | 750 | A-98944.1 | AUGAuACUUCUGUCCuACCdTsdT | 795 |
| HFE2 | AD-47426 | 1404 | A-98945.1 | GGAcAGAAGuAucAucccudTsdT | 751 | A-98946.1 | AGGGAUGAuACUUCUGUCCdTsdT | 796 |
| HFE2 | AD-47432 | 1441 | A-98947.1 | uAuuAAAGcuAcAAAuucudTsdT | 752 | A-98948.1 | AGAAUUUGuAGCUUuAAuAdTsdT | 797 |

It should be noted that unmodified versions of each of the modified sequences shown are included within the scope of the invention.

TABLE 10B

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-47814 | 64 | A-99594.1 | uccAGAGAGcGcAAcAAcudTsdT | 798 | A-99595.1 | AGUUGUUGCGCUCUCUGGAdTsdT | 841 |
| TFR2 | AD-47820 | 66 | A-99596.1 | cAGAGAGcGcAAcAAcuGudTsdT | 799 | A-99597.1 | AcAGUUGUUGCGCUCUCUGdTsdT | 842 |
| TFR2 | AD-47826 | 239 | A-99598.1 | cAGGcAGccAAAccucAuudTsdT | 35 | A-99599.1 | AAUGAGGUUUGGCUGCCUGdTsdT | 38 |
| TFR2 | AD-47819 | 772 | A-99674.1 | AGcuGGuGuAcGcccAcuAdTsdT | 800 | A-99675.1 | uAGUGGGCGuAcACcAGCUdTsdT | 843 |
| TFR2 | AD-47832 | 884 | A-99600.1 | ccAGAAGGuGAccAAuGcudTsdT | 801 | A-99601.1 | AGcAUUGGUcACCUUCUGGdTsdT | 844 |
| TFR2 | AD-47838 | 886 | A-99602.1 | AGAAGGuGAccAAuGcucAdTsdT | 802 | A-99603.1 | UGAGcAUUGGUcACCUUCUdTsdT | 845 |
| TFR2 | AD-47844 | 915 | A-99604.1 | GcucAAGGAGuGcucAuAudTsdT | 803 | A-99605.1 | AuAUGAGcACUCCUUGAGCdTsdT | 856 |
| TFR2 | AD-47849 | 916 | A-99606.1 | cucAAGGAGuGcucAuAudTsdT | 804 | A-99607.1 | uAuAUGAGcACUCCUUGAGdTsdT | 847 |
| TFR2 | AD-47854 | 920 | A-99608.1 | AGGAGuGcucAuAuAcccAdTsdT | 805 | A-99609.1 | UGGGuAuAUGAGcACUCCUdTsdT | 848 |
| TFR2 | AD-47815 | 922 | A-99610.1 | GAGuGcucAuAuAcccAGAdTsdT | 806 | A-99611.1 | UCUGGGuAuAUGAGcACUCdTsdT | 849 |
| TFR2 | AD-47825 | 1004 | A-99676.1 | AcAuGuGcAccuGGGAAcudTsdT | 807 | A-99677.1 | AGUUCCcAGGUGcAcAUGUdTsdT | 850 |
| TFR2 | AD-47821 | 1048 | A-99612.1 | cuuccuucAAucAAAcccAdTsdT | 808 | A-99613.1 | UGGGUUUGAUUGAAGGAAGdTsdT | 851 |
| TFR2 | AD-47827 | 1050 | A-99614.1 | uccuucAAucAAAcccAGudTsdT | 809 | A-99615.1 | ACUGGGUUUGAUUGAAGGAdTsdT | 852 |

TABLE 10B-continued

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-47833 | 1051 | A-99616.1 | ccuucAAucAAAcccAGuudTsdT | 47 | A-99617.1 | AACUGGGUUUGAUUGAAGGdTsdT | 48 |
| TFR2 | AD-51696 | 1051 | A-107271.3 | ccuucAAucAAAcccAGuUdTsdT | 47 | A-107257.2 | AACUGGGUUUGAuUGAAGGdTsdT | 48 |
| TFR2 | AD-51708 | 1051 | A-107271.5 | ccuucAAucAAAcccAGuUdTsdT | 47 | A-107259.2 | AACUGGGUuUGAuUGAAGGdTsdT | 48 |
| TFR2 | AD-51700 | 1051 | A-99616.5 | ccuucAAucAAAcccAGuudTsdT | 47 | A-107258.1 | AACUGGGUuUGAUUGAAGGdTsdT | 48 |
| TFR2 | AD-51701 | 1051 | A-99616.13 | ccuucAAucAAAcccAGuudTsdT | 47 | A-107266.1 | AACuGGGUuUGAUUGAAGGdTsdT | 48 |
| TFR2 | AD-51702 | 1051 | A-107271.4 | ccuucAAucAAAcccAGuUdTsdT | 47 | A-107258.2 | AACUGGGUuUGAUUGAAGGdTsdT | 48 |
| TFR2 | AD-51707 | 1051 | A-99616.14 | ccuucAAucAAAcccAGuudTsdT | 47 | A-107267.1 | AACuGGGUuUGAuUGAAGGdTsdT | 48 |
| TFR2 | AD-51694 | 1051 | A-99616.4 | ccuucAAucAAAcccAGuudTsdT | 47 | A-107257.1 | AACUGGGUUUGAuUGAAGGdTsdT | 48 |
| TFR2 | AD-51706 | 1051 | A-99616.6 | ccuucAAucAAAcccAGuudTsdT | 47 | A-107259.1 | AACUGGGUuUGAuUGAAGGdTsdT | 48 |
| TFR2 | AD-51695 | 1051 | A-99616.12 | ccuucAAucAAAcccAGuudTsdT | 47 | A-107265.1 | AACuGGGUUUGAuUGAAGGdTsdT | 48 |
| TFR2 | AD-51713 | 1051 | A-99616.15 | ccuucAAucAAAcccAGuudTsdT | 47 | A-107268.1 | AACUGGGUuUGAuuGAAGGdTsdT | 48 |
| TFR2 | AD-51714 | 1051 | A-107271.6 | ccuucAAucAAAcccAGuUdTsdT | 47 | A-107260.1 | AACUGGGUuUGAuuGAAGGdTsdT | 48 |
| TFR2 | AD-51683 | 1051 | A-99616.10 | ccuucAAucAAAcccAGuudTsdT | 47 | A-107263.1 | AACuGGGUUUGAUUGAAGgdTsdT | 48 |
| TFR2 | AD-51712 | 1051 | A-99616.7 | ccuucAAucAAAcccAGuudTsdT | 47 | A-107260.1 | AACUGGGUuUGAuuGAAGGdTsdT | 48 |
| TFR2 | AD-51720 | 1051 | A-107271.7 | ccuucAAucAAAcccAGuUdTsdT | 47 | A-107261.2 | AACUGGGUuUGAuuGAAGgdTsdT | 48 |
| TFR2 | AD-51719 | 1051 | A-99616.16 | ccuucAAucAAAcccAGuudTsdT | 47 | A-107269.1 | AACuGGGUuUGAuuGAAGgdTsdT | 48 |
| TFR2 | AD-51684 | 1051 | A-107271.1 | ccuucAAucAAAcccAGuUdTsdT | 47 | A-107255.2 | AACUGGGUUUGAUUGAAGgdTsdT | 48 |
| TFR2 | AD-51690 | 1051 | A-107271.2 | ccuucAAucAAAcccAGuUdTsdT | 47 | A-107256.2 | AACUGGGUUUGAUuGAAGGdTsdT | 48 |
| TFR2 | AD-51689 | 1051 | A-99616.11 | ccuucAAucAAAcccAGuudTsdT | 47 | A-107264.1 | AACuGGGUUUGAUuGAAGGdTsdT | 48 |
| TFR2 | AD-51682 | 1051 | A-99616.2 | ccuucAAucAAAcccAGuudTsdT | 47 | A-107255.1 | AACUGGGUUUGAUUGAAGgdTsdT | 48 |
| TFR2 | AD-51688 | 1051 | A-99616.3 | ccuucAAucAAAcccAGuudTsdT | 47 | A-107256.1 | AACUGGGUUUGAUuGAAGGdTsdT | 48 |
| TFR2 | AD-51718 | 1051 | A-99616.8 | ccuucAAucAAAcccAGuudTsdT | 47 | A-107261.1 | AACUGGGUuUGAuuGAAGgdTsdT | 48 |
| TFR2 | AD-51725 | 1051 | A-99616.17 | ccuucAAucAAAcccAGuudTsdT | 47 | A-107270.1 | AACuGGGUuUGAUuGAAGGdTsdT | 48 |
| TFR2 | AD-51724 | 1051 | A-99616.9 | ccuucAAucAAAcccAGuudTsdT | 47 | A-107262.1 | AACUGGGUuUGAUuGAAGgdTsdT | 48 |
| TFR2 | AD-47839 | 1067 | A-99618.1 | GuucccuccAGuuGcAucAdTsdT | 810 | A-99619.1 | UGAUGcAACUGGAGGGAACdTsdT | 853 |

TABLE 10B-continued

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-47845 | 1068 | A-99620.1 | uucccuccAGuuGcAucAudTsdT | 811 | A-99621.1 | AUGAUGcAACUGGAGGGAAdTsdT | 854 |
| TFR2 | AD-47850 | 1299 | A-99622.1 | cGcucAGAGccAGAucAcudTsdT | 812 | A-99623.1 | AGUGAUCUGGCUCUGAGCGdTsdT | 855 |
| TFR2 | AD-47855 | 1355 | A-99624.1 | AGGAGcAGcuAAAuccGcudTsdT | 813 | A-99625.1 | AGCGGAUUuAGCUGCUCCUdTsdT | 856 |
| TFR2 | AD-47816 | 1441 | A-99626.1 | cccGcAGAAGucuccucuudTsdT | 814 | A-99267.1 | AAGAGGAGACUUCUGCGGGdTsdT | 857 |
| TFR2 | AD-47831 | 1548 | A-99678.1 | GuGuAcGuGAGccuGGAcAdTsdT | 815 | A-99679.1 | UGUCcAGGCUcACGuAcACdTsdT | 858 |
| TFR2 | AD-47822 | 1584 | A-99628.1 | GAcAAGuuucAuGccAAGAdTsdT | 816 | A-99629.1 | UCUUGGcAUGAAACUUGUCdTsdT | 859 |
| TFR2 | AD-47828 | 1612 | A-99630.1 | uucuGAcAAGcucAuuGAdTsdT | 817 | A-99631.1 | UcAAUGAGACUUGUcAGAAdTsdT | 860 |
| TFR2 | AD-47834 | 1614 | A-99632.1 | cuGAcAAGcucAuuGAGAdTsdT | 818 | A-99633.1 | UCUcAAUGAGACUUGUcAGdTsdT | 861 |
| TFR2 | AD-47840 | 1616 | A-99634.1 | GAcAAGcucAuuGAGAGudTsdT | 819 | A-99635.1 | ACUCUcAAUGAGACUUGUCdTsdT | 862 |
| TFR2 | AD-47846 | 1618 | A-99636.1 | cAAGcucAuuGAGAGuGudTsdT | 820 | A-99637.1 | AcACUCUcAAUGAGACUUGdTsdT | 863 |
| TFR2 | AD-47851 | 2140 | A-99638.1 | AGcGAcuGAcAcGcAuGuAdTsdT | 821 | A-99639.1 | uAcAUGCGUGUcAGUCGCUdTsdT | 864 |
| TFR2 | AD-47856 | 2142 | A-99640.1 | cGAcuGAcAcGcAuGuAcAdTsdT | 822 | A-99641.1 | UGuAcAUGCGUGUcAGUCGdTsdT | 865 |
| TFR2 | AD-47817 | 2143 | A-99642.1 | GAcuGAcAcGcAuGuAcAAdTsdT | 823 | A-99643.1 | UUGuAcAUGCGUGUcAGUCdTsdT | 866 |
| TFR2 | AD-47823 | 2146 | A-99644.1 | uGAcAcGcAuGuAcAAcGudTsdT | 824 | A-99645.1 | ACGUUGuAcAUGCGUGUcAdTsdT | 867 |
| TFR2 | AD-47837 | 2151 | A-99680.1 | cGcAuGuAcAAcGuGcGcAdTsdT | 825 | A-99681.1 | UGCGcACGUUGuAcAUGCGdTsdT | 868 |
| TFR2 | AD-47843 | 2152 | A-99682.1 | GcAuGuAcAAcGuGcGcAudTsdT | 826 | A-99683.1 | AUGCGcACGUUGuAcAUGCdTsdT | 869 |
| TFR2 | AD-47829 | 2154 | A-99646.1 | AuGuAcAAcGuGcGcAuAAdTsdT | 827 | A-99647.1 | UuAUGCGcACGUUGuAcAUdTsdT | 870 |
| TFR2 | AD-47835 | 2155 | A-99648.1 | uGuAcAAcGuGcGcAuAAudTsdT | 828 | A-99649.1 | AUuAUGCGcACGUUGuAcAdTsdT | 871 |
| TFR2 | AD-47841 | 2170 | A-99650.1 | uAAuGcGGGuGGAGuucuAdTsdT | 829 | A-99651.1 | uAGAACUCcACCCGcAUuAdTsdT | 872 |
| TFR2 | AD-51703 | 2170 | A-99650.6 | uAAuGcGGGuGGAGuucuAdTsdT | 829 | A-107249.1 | UAGAACUcCACCCGcAUuAdTsdT | 872 |
| TFR2 | AD-51710 | 2170 | A-107254.2 | uAAuGcGGGuGGAGuUCuAdTsdT | 829 | A-107246.3 | UAGAACUCcACCCGcAUUAdTsdT | 872 |
| TFR2 | AD-51697 | 2170 | A-99650.5 | uAAuGcGGGuGGAGuucuAdTsdT | 829 | A-107248.1 | UAGAACUCcACCCGcAuuadTsdT | 872 |
| TFR2 | AD-51692 | 2170 | A-107253.3 | uAAuGcGGGuGGAGuuCuAdTsdT | 829 | A-107247.2 | UAGAACUCcACCCGcAUuadTsdT | 872 |
| TFR2 | AD-51685 | 2170 | A-99650.3 | uAAuGcGGGuGGAGuucuAdTsdT | 829 | A-107246.1 | UAGAACUCcACCCGcAUUAdTsdT | 872 |
| TFR2 | AD-51691 | 2170 | A-99650.4 | uAAuGcGGGuGGAGuucuAdTsdT | 829 | A-107247.1 | UAGAACUCcACCCGcAUuadTsdT | 872 |

TABLE 10B-continued

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-51698 | 2170 | A-107253.4 | uAAuGcGGGuGGAGuuCuAdTsdT | 829 | A-107248.2 | UAGAACUCcACCCGcAuuadTsdT | 872 |
| TFR2 | AD-51686 | 2170 | A-107253.2 | uAAuGcGGGuGGAGuuCuAdTsdT | 829 | A-107246.2 | UAGAACUCcACCCGcAuuAdTsdT | 872 |
| TFR2 | AD-51709 | 2170 | A-99650.7 | uAAuGcGGGuGGAGuucuAdTsdT | 829 | A-107250.1 | UAGAACuCcACCCGcAuuAdTsdT | 872 |
| TFR2 | AD-51679 | 2170 | A-99650.2 | uAAuGcGGGuGGAGuucuAdTsdT | 829 | A-107245.1 | UAGAACUCcACCCGcAUuAdTsdT | 872 |
| TFR2 | AD-51705 | 2170 | A-107254.5 | uAAuGcGGGuGGAGuUCuAdTsdT | 829 | A-107249.3 | UAGAACuCcACCCGcAUuAdTsdT | 872 |
| TFR2 | AD-51704 | 2170 | A-107254.1 | uAAuGcGGGuGGAGuUCuAdTsdT | 829 | A-107245.3 | UAGAACUCcACCCGcAUuAdTsdT | 872 |
| TFR2 | AD-51687 | 2170 | A-107253.6 | uAAuGcGGGuGGAGuuCuAdTsdT | 829 | A-107250.2 | UAGAACuCcACCCGcAuuAdTsdT | 872 |
| TFR2 | AD-51681 | 2170 | A-107253.5 | uAAuGcGGGuGGAGuuCuAdTsdT | 829 | A-107249.2 | UAGAACuCcACCCGcAUuAdTsdT | 872 |
| TFR2 | AD-51716 | 2170 | A-107254.3 | uAAuGcGGGuGGAGuUCuAdTsdT | 829 | A-107247.3 | UAGAACUCcACCCGcAUuadTsdT | 872 |
| TFR2 | AD-51693 | 2170 | A-107253.7 | uAAuGcGGGuGGAGuuCuAdTsdT | 829 | A-107251.2 | UAGAACuCcACCCGcUAuadTsdT | 872 |
| TFR2 | AD-51711 | 2170 | A-107254.6 | uAAuGcGGGuGGAGuUCuAdTsdT | 829 | A-107250.3 | UAGAACuCcACCCGcAuuAdTsdT | 872 |
| TFR2 | AD-51699 | 2170 | A-107253.8 | uAAuGcGGGuGGAGuuCuAdTsdT | 829 | A-107252.2 | UAGAACuCcACCCGcAuuadTsdT | 872 |
| TFR2 | AD-51722 | 2170 | A-107254.4 | uAAuGcGGGuGGAGuUCuAdTsdT | 829 | A-107248.3 | UAGAACUCcACCCGcAuuadTsdT | 872 |
| TFR2 | AD-51715 | 2170 | A-99650.8 | uAAuGcGGGuGGAGuucuAdTsdT | 829 | A-107251.1 | UAGAACuCcACCCGcAUuadTsdT | 872 |
| TFR2 | AD-51680 | 2170 | A-107253.1 | uAAuGcGGGuGGAGuuCuAdTsdT | 829 | A-107245.2 | UAGAACUCcACCCGcAUuAdTsdT | 872 |
| TFR2 | AD-51717 | 2170 | A-107254.7 | uAAuGcGGGuGGAGuUCuAdTsdT | 829 | A-107251.3 | UAGAACuCcACCCGcAUuadTsdT | 872 |
| TFR2 | AD-51723 | 2170 | A-107254.8 | uAAuGcGGGuGGAGuUCuAdTsdT | 829 | A-107252.3 | UAGAACuCcACCCGcAuuadTsdT | 872 |
| TFR2 | AD-51721 | 2170 | A-99650.9 | uAAuGcGGGuGGAGuucuAdTsdT | 829 | A-107252.1 | UAGAACuCcACCCGcAuuadTsdT | 872 |
| TFR2 | AD-47847 | 2178 | A-99652.1 | GuGGAGuucuAcuuccuuudTsdT | 830 | A-99653.1 | AAAGGAAGuAGAACUCcACdTsdT | 873 |
| TFR2 | AD-47852 | 2224 | A-99654.1 | cGuuccGccAcAucuucAudTsdT | 831 | A-99655.1 | AUGAAGAUGUGGCGGAACGdTsdT | 874 |
| TFR2 | AD-47857 | 2425 | A-99656.1 | GGAAcAuuGAuAAcAAcuudTsdT | 832 | A-99657.1 | AAGUUGUuAUcAAUGUUCCdTsdT | 875 |
| TFR2 | AD-47818 | 2602 | A-99658.1 | cAGcAcAGAuAuccAcAcAdTsdT | 833 | A-99659.1 | UGUGUGGAuAUCUGUGCUGdTsdT | 876 |
| TFR2 | AD-47824 | 2656 | A-99660.1 | GGucAuAcuGucGGuuAAudTsdT | 834 | A-99661.1 | AUuAACCGAcAGuAUGACCdTsdT | 877 |
| TFR2 | AD-47830 | 2658 | A-99662.1 | ucAuAcuGucGGuuAAucAdTsdT | 835 | A-99663.1 | UGAUuAACCGAcAGuAUGAdTsdT | 878 |
| TFR2 | AD-47836 | 2660 | A-99664.1 | AuAcuGucGGuuAAucAGAdTsdT | 836 | A-99665.1 | UCUGAUuAACCGAcAGuAUdTsdT | 879 |

TABLE 10B-continued

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-47842 | 2662 | A-99666.1 | AcuGucGGuuAAucAGAGAdTsdT | 837 | A-99667.1 | UCUCUGAUuAACCGAcAGUdTsdT | 880 |
| TFR2 | AD-47848 | 2719 | A-99668.1 | GGuccuccAuAccuAGAGAdTsdT | 838 | A-99669.1 | UCUCuAGGuAUGGAGGACCdTsdT | 881 |
| TFR2 | AD-47853 | 2795 | A-99670.1 | ucGcuGGcAccAuAGccuudTsdT | 839 | A-99671.1 | AAGGCuAUGGUGCcAGCGAdTsdT | 882 |
| TFR2 | AD-47858 | 2802 | A-99672.1 | cAccAuAGccuuAuGGccAdTsdT | 840 | A-99673.1 | UGGCcAuAAGGCuAUGGUGdTsdT | 883 |

It should be noted that unmodified versions of each on the modified sequences shown are included within the scope of the invention.

TABLE 11

Secondary Target single-dose

| Target | Reactivity | Duplex Name | Start Position | 10 nM overall Avg | 10 nM overall SD | 0.1 nM overall Avg | 0.1 nM overall SD | 0.01 nM overall Avg | 0.01 nM overall SD |
|---|---|---|---|---|---|---|---|---|---|
| HFE2 | Human | AD-47391 | 177 | 97.5 | 10.8 | 111.9 | 21.2 | | |
| HFE2 | Human | AD-47397 | 193 | 27.3 | 4.2 | 36.9 | 3.3 | | |
| HFE2 | Human | AD-47403 | 195 | 31.2 | 10.0 | 48.6 | 7.6 | | |
| HFE2 | Human | AD-47409 | 199 | 82.3 | 15.8 | 89.5 | 11.4 | | |
| HFE2 | Human | AD-47415 | 200 | 44.8 | 5.9 | 51.1 | 7.0 | | |
| HFE2 | Human | AD-47421 | 206 | 27.8 | 8.1 | 28.8 | 0.9 | | |
| HFE2 | Human | AD-47427 | 211 | 96.4 | 25.8 | 79.8 | 18.2 | | |
| HFE2 | Human | AD-47433 | 244 | 7.5 | 1.3 | 21.2 | 4.0 | | |
| HFE2 | Human | AD-47392 | 257 | 8.6 | 2.0 | 20.5 | 8.1 | | |
| HFE2 | Human | AD-47398 | 261 | 30.0 | 6.5 | 45.9 | 6.4 | | |
| HFE2 | Human | AD-47404 | 290 | 9.3 | 2.8 | 20.5 | 0.5 | | |
| HFE2 | Human | AD-47410 | 360 | 28.7 | 9.8 | 36.7 | 1.8 | | |
| HFE2 | Human | AD-47416 | 367 | 72.3 | 32.5 | 79.2 | 19.3 | | |
| HFE2 | Human | AD-47422 | 404 | 20.4 | 2.5 | 35.4 | 2.5 | | |
| HFE2 | Human | AD-47428 | 415 | 66.8 | 22.5 | 80.6 | 11.4 | | |
| HFE2 | Human | AD-47434 | 417 | 34.7 | 5.9 | 28.6 | 3.4 | | |
| HFE2 | Human | AD-47393 | 472 | 96.3 | 9.7 | 99.8 | 31.3 | | |
| HFE2 | Human | AD-47399 | 585 | 10.0 | 6.6 | 16.3 | 0.6 | | |
| HFE2 | Human | AD-47405 | 587 | 11.3 | 2.1 | 14.0 | 0.4 | | |
| HFE2 | Human | AD-47417 | 638 | 39.3 | 2.0 | 62.6 | 7.6 | | |
| HFE2 | Human | AD-47423 | 642 | 109.4 | 4.1 | 58.5 | 0.9 | | |
| HFE2 | Human | AD-47429 | 646 | 56.0 | 13.0 | 76.3 | 21.8 | | |
| HFE2 | Human | AD-47435 | 656 | 17.7 | 1.4 | 29.3 | 9.4 | | |
| HFE2 | Human | AD-47394 | 657 | 8.8 | 7.3 | 9.8 | 6.3 | | |
| HFE2 | Human | AD-47400 | 678 | 21.2 | 2.8 | 25.1 | 8.4 | | |
| HFE2 | Human | AD-47406 | 1121 | 12.9 | 1.4 | 20.5 | 1.3 | | |
| HFE2 | Human | AD-47412 | 1151 | 16.5 | 5.2 | 11.8 | 3.2 | | |
| HFE2 | Human | AD-47418 | 1152 | 16.0 | 1.6 | 8.4 | 2.2 | | |
| HFE2 | Human | AD-47424 | 1203 | 9.2 | 1.6 | 14.0 | 2.4 | | |
| HFE2 | Human | AD-47430 | 1228 | 14.8 | 2.7 | 19.2 | 0.9 | | |
| HFE2 | Human | AD-47436 | 1230 | 17.9 | 9.6 | 19.7 | 1.4 | | |
| HFE2 | Human | AD-47395 | 1233 | 15.3 | 2.1 | 12.7 | 2.2 | | |
| HFE2 | Human | AD-47401 | 1272 | 6.3 | 1.2 | 10.5 | 0.9 | | |
| HFE2 | Human | AD-47407 | 1273 | 5.6 | 1.8 | 5.6 | 0.8 | | |
| HFE2 | Human | AD-51740 | 1273 | 5.7 | 0.0 | 6.5 | 0.7 | 6.3 | 0.4 |
| HFE2 | Human | AD-51747 | 1273 | 7.1 | 1.6 | 6.0 | 0.1 | 7.0 | 0.1 |
| HFE2 | Human | AD-51744 | 1273 | 11.8 | 5.8 | 18.4 | 14.1 | 7.7 | 0.0 |
| HFE2 | Human | AD-51731 | 1273 | 6.2 | 0.7 | 7.1 | 0.2 | 8.1 | 3.2 |
| HFE2 | Human | AD-51736 | 1273 | 6.3 | 0.3 | 7.2 | 0.7 | 8.2 | 0.5 |
| HFE2 | Human | AD-51732 | 1273 | 6.0 | 1.0 | 8.2 | 0.5 | 8.3 | 0.6 |
| HFE2 | Human | AD-51734 | 1273 | 6.9 | 0.3 | 14.5 | 13.3 | 8.4 | 1.4 |
| HFE2 | Human | AD-51748 | 1273 | 6.6 | 0.2 | 7.7 | 0.9 | 8.5 | 1.3 |
| HFE2 | Human | AD-51735 | 1273 | 6.4 | 1.5 | 6.3 | 0.3 | 8.5 | 0.7 |
| HFE2 | Human | AD-51749 | 1273 | 6.8 | 1.0 | 8.3 | 0.4 | 8.7 | 2.2 |
| HFE2 | Human | AD-51752 | 1273 | 12.7 | 6.4 | 10.3 | 3.6 | 8.8 | 1.0 |
| HFE2 | Human | AD-51738 | 1273 | 5.8 | 0.6 | 9.2 | 3.0 | 8.9 | 1.4 |
| HFE2 | Human | AD-51730 | 1273 | 7.6 | 1.7 | 7.8 | 1.0 | 9.3 | 0.5 |
| HFE2 | Human | AD-51745 | 1273 | 5.8 | 0.4 | 6.5 | 1.6 | 9.5 | 1.2 |
| HFE2 | Human | AD-51737 | 1273 | 5.9 | 0.1 | 19.8 | 18.4 | 9.6 | 1.3 |
| HFE2 | Human | AD-51743 | 1273 | 6.5 | 1.6 | 7.0 | 1.5 | 9.9 | 2.0 |
| HFE2 | Human | AD-51751 | 1273 | 6.4 | 1.4 | 7.5 | 1.6 | 10.3 | 1.6 |
| HFE2 | Human | AD-51750 | 1273 | 6.9 | 0.2 | 8.8 | 0.3 | 10.7 | 1.0 |

TABLE 11-continued

Secondary Target single-dose

| Target | Reactivity | Duplex Name | Start Position | 10 nM overall Avg | SD | 0.1 nM overall Avg | SD | 0.01 nM overall Avg | SD |
|---|---|---|---|---|---|---|---|---|---|
| HFE2 | Human | AD-51741 | 1273 | 6.0 | 2.1 | 8.5 | 1.1 | 10.8 | 4.0 |
| HFE2 | Human | AD-51742 | 1273 | 7.0 | 1.0 | 6.1 | 0.2 | 11.0 | 0.9 |
| HFE2 | Human | AD-51733 | 1273 | 6.7 | 1.1 | 7.2 | 0.1 | 11.0 | 1.3 |
| HFE2 | Human | AD-51755 | 1273 | 6.1 | 0.8 | 13.4 | 6.9 | 11.2 | 2.8 |
| HFE2 | Human | AD-51756 | 1273 | 9.8 | 0.3 | 8.9 | 0.4 | 11.6 | 0.3 |
| HFE2 | Human | AD-51728 | 1273 | 7.1 | 0.8 | 8.2 | 0.2 | 11.6 | 0.6 |
| HFE2 | Human | AD-51729 | 1273 | 6.8 | 1.2 | 8.9 | 0.4 | 11.7 | 0.5 |
| HFE2 | Human | AD-51726 | 1273 | 7.1 | 0.6 | 9.0 | 1.0 | 12.6 | 2.4 |
| HFE2 | Human | AD-51746 | 1273 | 7.3 | 1.4 | 14.9 | 6.0 | 12.6 | 5.5 |
| HFE2 | Human | AD-51757 | 1273 | 9.1 | 2.0 | 10.4 | 0.6 | 13.1 | 1.9 |
| HFE2 | Human | AD-51727 | 1273 | 6.7 | 1.0 | 8.5 | 1.1 | 13.8 | 0.4 |
| HFE2 | Human | AD-51753 | 1273 | 7.2 | 0.3 | 13.6 | 8.4 | 14.2 | 7.8 |
| HFE2 | Human | AD-51754 | 1273 | 6.9 | 0.4 | 10.1 | 1.0 | 14.7 | 2.8 |
| HFE2 | Human | AD-51739 | 1273 | 6.1 | 0.1 | 8.2 | 0.1 | 14.8 | 8.9 |
| HFE2 | Human | AD-47413 | 1274 | 7.2 | 0.2 | 6.4 | 0.9 | | |
| HFE2 | Human | AD-47419 | 1279 | 8.6 | 2.3 | 10.0 | 2.2 | | |
| HFE2 | Human | AD-47425 | 1280 | 14.5 | 1.0 | 14.1 | 0.8 | | |
| HFE2 | Human | AD-47431 | 1303 | 49.5 | 0.6 | 72.2 | 0.7 | | |
| HFE2 | Human | AD-47437 | 1366 | 6.4 | 4.2 | 11.4 | 2.4 | | |
| HFE2 | Human | AD-47396 | 1367 | 4.6 | 0.1 | 10.0 | 0.2 | | |
| HFE2 | Human | AD-47402 | 1396 | 11.8 | 0.2 | 19.9 | 4.4 | | |
| HFE2 | Human | AD-47408 | 1397 | 12.0 | 3.4 | 13.7 | 0.2 | | |
| HFE2 | Human | AD-47414 | 1399 | 5.6 | 1.5 | 8.2 | 0.1 | | |
| HFE2 | Human | AD-47420 | 1400 | 3.6 | 1.0 | 5.7 | 0.8 | | |
| HFE2 | Human | AD-47426 | 1404 | 13.7 | 3.8 | 27.1 | 3.1 | | |
| HFE2 | Human | AD-47432 | 1441 | 3.8 | 0.0 | 5.6 | 1.0 | | |
| TFR2 | Human | AD-47814 | 64 | 7.8 | 0.4 | 16.3 | 0.1 | | |
| TFR2 | Human | AD-47820 | 66 | 13.7 | 2.5 | 25.1 | 3.7 | | |
| TFR2 | Human | AD-47826 | 239 | 13.5 | 1.8 | 25.4 | 4.3 | | |
| TFR2 | Human | AD-47819 | 772 | 112.4 | 2.9 | 102.9 | 3.8 | | |
| TFR2 | Human | AD-47832 | 884 | 24.2 | 1.8 | 52.4 | 2.7 | | |
| TFR2 | Human | AD-47838 | 886 | 23.6 | 0.4 | 39.0 | 1.6 | | |
| TFR2 | Human | AD-47844 | 915 | 19.5 | 3.9 | 40.9 | 4.5 | | |
| TFR2 | Human | AD-47849 | 916 | 14.2 | 6.9 | 22.8 | 0.5 | | |
| TFR2 | Human | AD-47854 | 920 | 69.4 | 4.2 | 88.3 | 0.8 | | |
| TFR2 | Human | AD-47815 | 922 | 66.3 | 6.7 | 71.2 | 8.8 | | |
| TFR2 | Human | AD-47825 | 1004 | 23.9 | 2.9 | 46.2 | 3.8 | | |
| TFR2 | Human | AD-47821 | 1048 | 57.4 | 15.9 | 78.5 | 5.0 | | |
| TFR2 | Human | AD-47827 | 1050 | 18.9 | 8.3 | 37.9 | 2.9 | | |
| TFR2 | Human | AD-47833 | 1051 | 8.3 | 4.3 | 19.7 | 5.4 | | |
| TFR2 | Human | AD-51696 | 1051 | 8.0 | 2.1 | 21.1 | 2.1 | 27.2 | 0.5 |
| TFR2 | Human | AD-51708 | 1051 | 8.8 | 1.2 | 17.7 | 0.8 | 28.5 | 3.7 |
| TFR2 | Human | AD-51700 | 1051 | 9.3 | 1.2 | 19.8 | 3.7 | 30.1 | 5.0 |
| TFR2 | Human | AD-51701 | 1051 | 9.4 | 0.6 | 22.3 | 8.1 | 30.8 | 2.7 |
| TFR2 | Human | AD-51702 | 1051 | 8.7 | 2.1 | 19.7 | 0.1 | 30.9 | 1.4 |
| TFR2 | Human | AD-51707 | 1051 | 8.1 | 2.5 | 19.1 | 2.6 | 32.2 | 8.2 |
| TFR2 | Human | AD-51694 | 1051 | 9.3 | 1.9 | 19.3 | 2.5 | 38.8 | 0.0 |
| TFR2 | Human | AD-51706 | 1051 | 8.4 | 0.3 | 19.5 | 1.5 | 39.9 | 6.9 |
| TFR2 | Human | AD-51695 | 1051 | 10.1 | 1.6 | 19.9 | 2.4 | 40.1 | 4.2 |
| TFR2 | Human | AD-51713 | 1051 | 14.6 | 1.8 | 45.3 | 2.5 | 59.0 | 1.6 |
| TFR2 | Human | AD-51714 | 1051 | 22.1 | 0.1 | 44.2 | 1.5 | 62.8 | 1.7 |
| TFR2 | Human | AD-51683 | 1051 | 9.7 | 0.6 | 36.5 | 2.4 | 66.0 | 2.4 |
| TFR2 | Human | AD-51712 | 1051 | 21.2 | 2.6 | 44.1 | 4.5 | 67.1 | 5.9 |
| TFR2 | Human | AD-51720 | 1051 | 34.5 | 6.1 | 58.3 | 10.4 | 67.4 | 0.0 |
| TFR2 | Human | AD-51719 | 1051 | 38.6 | 1.2 | 57.7 | 1.2 | 68.8 | 3.2 |
| TFR2 | Human | AD-51684 | 1051 | 14.7 | 3.5 | 48.3 | 1.9 | 69.3 | 3.5 |
| TFR2 | Human | AD-51690 | 1051 | 19.7 | 0.0 | 49.8 | 0.5 | 74.1 | 12.6 |
| TFR2 | Human | AD-51689 | 1051 | 40.5 | 2.4 | 53.1 | 9.7 | 75.0 | 6.4 |
| TFR2 | Human | AD-51682 | 1051 | 12.7 | 1.1 | 42.3 | 10.1 | 75.7 | 6.0 |
| TFR2 | Human | AD-51688 | 1051 | 34.9 | 2.9 | 62.2 | 6.9 | 78.1 | 3.2 |
| TFR2 | Human | AD-51718 | 1051 | 31.6 | 6.6 | 53.1 | 6.5 | 80.2 | 1.3 |
| TFR2 | Human | AD-51725 | 1051 | 47.9 | 5.0 | 76.1 | 1.8 | 83.7 | 3.2 |
| TFR2 | Human | AD-51724 | 1051 | 52.0 | 1.2 | 66.1 | 32.9 | 87.8 | 14.9 |
| TFR2 | Human | AD-47839 | 1067 | 54.0 | 3.1 | 71.5 | 8.4 | | |
| TFR2 | Human | AD-47845 | 1068 | 105.7 | 20.1 | 98.0 | 3.0 | | |
| TFR2 | Human | AD-47850 | 1299 | 16.7 | 4.8 | 21.3 | 3.2 | | |
| TFR2 | Human | AD-47855 | 1355 | 64.6 | 0.5 | 66.1 | 8.0 | | |
| TFR2 | Human | AD-47816 | 1441 | 10.6 | 2.6 | 30.6 | 6.9 | | |
| TFR2 | Human | AD-47831 | 1548 | 22.8 | 0.2 | 36.6 | 9.5 | | |
| TFR2 | Human | AD-47822 | 1584 | 57.2 | 7.0 | 72.6 | 1.6 | | |
| TFR2 | Human | AD-47828 | 1612 | 38.2 | 5.9 | 61.2 | 9.9 | | |
| TFR2 | Human | AD-47834 | 1614 | 9.2 | 3.6 | 20.1 | 3.0 | | |
| TFR2 | Human | AD-47840 | 1616 | 50.1 | 3.7 | 55.6 | 3.8 | | |
| TFR2 | Human | AD-47846 | 1618 | 75.0 | 7.9 | 94.6 | 4.3 | | |

TABLE 11-continued

Secondary Target single-dose

| Target | Reactivity | Duplex Name | Start Position | 10 nM overall Avg | SD | 0.1 nM overall Avg | SD | 0.01 nM overall Avg | SD |
|---|---|---|---|---|---|---|---|---|---|
| TFR2 | Human | AD-47851 | 2140 | 94.1 | 0.4 | 101.3 | 10.6 | | |
| TFR2 | Human | AD-47856 | 2142 | 63.3 | 4.1 | 60.7 | 3.1 | | |
| TFR2 | Human | AD-47817 | 2143 | 50.2 | 2.7 | 50.3 | 6.5 | | |
| TFR2 | Human | AD-47823 | 2146 | 26.1 | 2.3 | 40.9 | 3.3 | | |
| TFR2 | Human | AD-47837 | 2151 | 119.5 | 21.7 | 89.5 | 6.9 | | |
| TFR2 | Human | AD-47843 | 2152 | 20.6 | 1.7 | 34.9 | 7.8 | | |
| TFR2 | Human | AD-47829 | 2154 | 53.4 | 4.1 | 60.3 | 0.5 | | |
| TFR2 | Human | AD-47835 | 2155 | 15.5 | 1.8 | 18.3 | 2.4 | | |
| TFR2 | Human | AD-47841 | 2170 | 26.6 | 1.5 | 24.7 | 2.0 | | |
| TFR2 | Human | AD-51703 | 2170 | 25.2 | 2.8 | 27.9 | 3.5 | 23.2 | 1.1 |
| TFR2 | Human | AD-51710 | 2170 | 22.1 | 3.4 | 23.1 | 0.5 | 24.0 | 0.6 |
| TFR2 | Human | AD-51697 | 2170 | 30.9 | 3.6 | 25.3 | 0.9 | 24.5 | 0.8 |
| TFR2 | Human | AD-51692 | 2170 | 23.1 | 1.3 | 24.6 | 1.2 | 24.9 | 6.4 |
| TFR2 | Human | AD-51685 | 2170 | 24.6 | 2.2 | 23.9 | 0.6 | 25.6 | 1.7 |
| TFR2 | Human | AD-51691 | 2170 | 29.1 | 3.2 | 21.3 | 0.2 | 26.4 | 3.7 |
| TFR2 | Human | AD-51698 | 2170 | 23.1 | 2.3 | 25.8 | 3.0 | 26.8 | 2.8 |
| TFR2 | Human | AD-51686 | 2170 | 20.7 | 2.5 | 24.7 | 0.7 | 27.5 | 1.4 |
| TFR2 | Human | AD-51709 | 2170 | 23.1 | 1.3 | 25.1 | 2.7 | 27.7 | 2.1 |
| TFR2 | Human | AD-51679 | 2170 | 27.4 | 2.2 | 26.4 | 4.3 | 28.3 | 5.1 |
| TFR2 | Human | AD-51705 | 2170 | 27.8 | 5.3 | 24.6 | 2.0 | 28.8 | 2.4 |
| TFR2 | Human | AD-51704 | 2170 | 23.9 | 2.1 | 26.1 | 0.5 | 29.2 | 4.6 |
| TFR2 | Human | AD-51687 | 2170 | 20.8 | 3.9 | 27.7 | 2.8 | 29.4 | 1.0 |
| TFR2 | Human | AD-51681 | 2170 | 30.0 | 1.8 | 31.2 | 1.8 | 29.5 | 4.7 |
| TFR2 | Human | AD-51716 | 2170 | 20.0 | 1.7 | 25.9 | 2.2 | 30.2 | 1.1 |
| TFR2 | Human | AD-51693 | 2170 | 26.2 | 0.8 | 26.1 | 1.0 | 30.6 | 0.6 |
| TFR2 | Human | AD-51711 | 2170 | 20.8 | 0.5 | 24.8 | 3.2 | 31.3 | 3.0 |
| TFR2 | Human | AD-51699 | 2170 | 20.9 | 0.7 | 27.3 | 1.5 | 31.7 | 5.1 |
| TFR2 | Human | AD-51722 | 2170 | 28.3 | 3.7 | 30.0 | 0.5 | 32.1 | 1.2 |
| TFR2 | Human | AD-51715 | 2170 | 22.2 | 6.1 | 30.4 | 0.6 | 34.6 | 1.3 |
| TFR2 | Human | AD-51680 | 2170 | 26.4 | 2.5 | 26.7 | 5.4 | 36.6 | 2.6 |
| TFR2 | Human | AD-51717 | 2170 | 28.2 | 6.2 | 24.6 | 0.2 | 37.2 | 7.7 |
| TFR2 | Human | AD-53723 | 2170 | 25.9 | 4.0 | 30.7 | 4.0 | 40.7 | 3.1 |
| TFR2 | Human | AD-51721 | 2170 | 30.7 | 1.6 | 28.1 | 0.9 | 40.8 | 0.3 |
| TFR2 | Human | AD-47847 | 2178 | 21.7 | 2.1 | 25.1 | 3.5 | | |
| TFR2 | Human | AD-47852 | 2224 | 71.4 | 2.2 | 66.7 | 7.1 | | |
| TFR2 | Human | AD-47857 | 2425 | 37.4 | 4.8 | 29.5 | 5.4 | | |
| TFR2 | Human | AD-47818 | 2602 | 48.3 | 4.8 | 50.8 | 4.3 | | |
| TFR2 | Human | AD-47824 | 2656 | 19.9 | 3.3 | 25.7 | 0.1 | | |
| TFR2 | Human | AD-47830 | 2658 | 25.8 | 7.7 | 25.8 | 6.4 | | |
| TFR2 | Human | AD-47836 | 2660 | 34.6 | 0.1 | 37.4 | 6.1 | | |
| TFR2 | Human | AD-47842 | 2662 | 39.2 | 6.8 | 26.3 | 1.1 | | |
| TFR2 | Human | AD-47848 | 2719 | 76.8 | 2.2 | 90.1 | 9.7 | | |
| TFR2 | Human | AD-47853 | 2795 | 28.1 | 6.3 | 43.7 | 3.8 | | |
| TFR2 | Human | AD-47858 | 2802 | 66.9 | 8.2 | 73.6 | 3.4 | | |

Data are expressed as percent of control (Mock transfected or 1955).

TABLE 12

Secondary Target does-response

| Target | Reactivity | Duplex Name | Start Position | IC50 (nM) |
|---|---|---|---|---|
| HFE2 | HumaWn | AD-47394 | 657 | 0.004 |
| HFE2 | Human | AD-47395 | 1233 | 0.011 |
| HFE2 | Human | AD-47407 | 1273 | 0.002 |
| HFE2 | Human | AD-51747 | 1273 | 0.001 |
| HFE2 | Human | AD-51736 | 1273 | 0.001 |
| HFE2 | Human | AD-51734 | 1273 | 0.001 |
| HFE2 | Human | AD-51732 | 1273 | 0.002 |
| HFE2 | Human | AD-51731 | 1273 | 0.002 |
| HFE2 | Human | AD-51744 | 1273 | 0.002 |
| HFE2 | Human | AD-51748 | 1273 | 0.002 |
| HFE2 | Human | AD-51735 | 1273 | 0.002 |
| HFE2 | Human | AD-47407 | 1273 | 0.002 |
| HFE2 | Human | AD-51740 | 1273 | 0.003 |
| HFE2 | Human | AD-47413 | 1274 | 0.003 |
| HFE2 | Human | AD-47425 | 1280 | 0.021 |
| HFE2 | Human | AD-47437 | 1366 | 0.015 |
| HFE2 | Human | AD-47396 | 1367 | 0.013 |
| HFE2 | Human | AD-47414 | 1399 | 0.005 |
| HFE2 | Human | AD-47420 | 1400 | 0.010 |
| HFE2 | Human | AD-47432 | 1441 | 0.004 |
| TFR2 | Human | AD-47814 | 64 | 0.012 |
| TFR2 | Human | AD-47820 | 66 | 0.011 |
| TFR2 | Human | AD-47826 | 239 | 0.014 |
| TFR2 | Human | AD-47849 | 916 | 0.067 |
| TFR2 | Human | AD-47833 | 1051 | 0.013 |
| TFR2 | Human | AD-51701 | 1051 | 0.015 |
| TFR2 | Human | AD-51708 | 1051 | 0.017 |
| TFR2 | Human | AD-51700 | 1051 | 0.017 |
| TFR2 | Human | AD-47833 | 1051 | 0.023 |
| TFR2 | Human | AD-51696 | 1051 | 0.024 |
| TFR2 | Human | AD-47850 | 1299 | 0.011 |
| TFR2 | Human | AD-47834 | 1614 | 0.014 |
| TFR2 | Human | AD-47835 | 2155 | 0.023 |
| TFR2 | Human | AD-47841 | 2170 | 0.009 |
| TFR2 | Human | AD-51710 | 2170 | 0.003 |
| TFR2 | Human | AD-51703 | 2170 | 0.005 |

TABLE 12-continued

| Secondary Target does-response | | | | |
|---|---|---|---|---|
| Target | Reactivity | Duplex Name | Start Position | IC50 (nM) |
| TFR2 | Human | AD-51697 | 2170 | 0.006 |
| TFR2 | Human | AD-51692 | 2170 | 0.010 |
| TFR2 | Human | AD-47841 | 2170 | 0.024 |
| TFR2 | Human | AD-47847 | 2178 | 0.013 |

TABLE 13

TFR2 Duplex Sequences

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-52549 | 64 | A-108802.1 | uccAGAGAGcGcAAcAAcUdTsdT | 798 | A-108798.2 | AGUUGUUGCGCUCUCuGGAdTsdT | 841 |
| TFR2 | AD-52550 | 64 | A-108802.5 | uccAGAGAGcGcAAcAAcUdTsdT | 798 | A-108803.2 | AGUUGUUGCGCUCUCuGGadTsdT | 841 |
| TFR2 | AD-52555 | 64 | A-108802.2 | UccAGAGAGcGcAAcAAcUdTsdT | 798 | A-108799.2 | AGUUGUUGCGCUCuCuGGAdTsdT | 841 |
| TFR2 | AD-52556 | 64 | A-108802.6 | uccAGAGAGcGcAAcAAcUdTsdT | 798 | A-108804.2 | AGUUGUUGCGCUCuCuGGadTsdT | 841 |
| TFR2 | AD-52561 | 64 | A-108802.3 | uccAGAGAGcGcAAcAAcUdTsdT | 798 | A-108800.2 | AGUUGUUGCGCuCuCuGGAdTsdT | 841 |
| TFR2 | AD-52562 | 64 | A-108802.7 | uccAGAGAGcGcAAcAAcUdTsdT | 798 | A-108805.2 | AGUUGUUGCGCuCuCuGGadTsdT | 841 |
| TFR2 | AD-52567 | 64 | A-108802.4 | uccAGAGAGcGcAAcAAcUdTsdT | 798 | A-108801.2 | AGUUGuUGCGCuCuCuGGAdTsdT | 841 |
| TFR2 | AD-52568 | 64 | A-108802.8 | uccAGAGAGcGcAAcAAcUdTsdT | 798 | A-108806.2 | AGUUGuUGCGCuCuCuGGadTsdT | 841 |
| TFR2 | AD-52572 | 64 | A-99594.2 | uccAGAGAGcGcAAcAAcudTsdT | 798 | A-108798.1 | AGUUGUUGCGCUCUCuGGAdTsdT | 841 |
| TFR2 | AD-52573 | 64 | A-99594.6 | uccAGAGAGcGcAAcAAcudTsdT | 798 | A-108803.1 | AGUUGUUGCGCUCUCuGGadTsdT | 841 |
| TFR2 | AD-52577 | 64 | A-99594.3 | uccAGAGAGcGcAAcAAcudTsdT | 798 | A-108799.1 | AGUUGUUGCGCUCuCuGGAdTsdT | 841 |
| TFR2 | AD-52578 | 64 | A-99594.7 | uccAGAGAGcGcAAcAAcudTsdT | 798 | A-108804.1 | AGUUGUUGCGCUCuCuGGadTsdT | 841 |
| TFR2 | AD-52582 | 64 | A-99594.4 | uccAGAGAGcGcAAcAAcudTsdT | 798 | A-108800.1 | AGUUGUUGCGCuCuCuGGAdTsdT | 841 |
| TFR2 | AD-52583 | 64 | A-99594.8 | uccAGAGAGcGcAAcAAcudTsdT | 798 | A-108805.1 | AGUUGUUGCGCuCuCuGGadTsdT | 841 |
| TFR2 | AD-52587 | 64 | A-99594.5 | uccAGAGAGcGcAAcAAcudTsdT | 798 | A-108801.1 | AGUUGuUGCGCuCuCuGGAdTsdT | 841 |
| TFR2 | AD-52588 | 64 | A-99594.9 | uccAGAGAGcGcAAcAAcudTsdT | 798 | A-108806.1 | AGUUGuUGCGCuCuCuGGadTsdT | 841 |
| TFR2 | AD-52551 | 239 | A-108811.1 | cAGGcAGccAAAccucAuUdTsdT | 35 | A-108810.2 | AAUGAGGUuUGGCuGcCuGdTsdT | 38 |
| TFR2 | AD-52552 | 239 | A-108811.3 | cAGGcAGccAAAccucAuUdTsdT | 35 | A-108816.1 | AAuGAGGUuUGGCUGCcugdTsdT | 38 |
| TFR2 | AD-52557 | 239 | A-108812.1 | cAGGcAGccAAAccuCAuUdTsdT | 35 | A-108810.3 | AAUGAGGUuUGGCuGcCuGdTsdT | 38 |
| TFR2 | AD-52558 | 239 | A-108812.3 | cAGGcAGccAAAccuCAuUdTsdT | 35 | A-108816.2 | AAuGAGGUuUGGCUGCcugdTsdT | 38 |
| TFR2 | AD-52563 | 239 | A-108813.1 | cAGGcAGccAAAcCuCAuUdTsdT | 35 | A-108810.4 | AAUGAGGUuUGGCuGcCuGdTsdT | 38 |

TABLE 13-continued

TFR2 Duplex Sequences

| Target | Duplex ID | Start Position | Sense Name | Sense Sequence | SEQ ID NO: | Antisense Name | Antisense Sequence | SEQ ID NO: |
|---|---|---|---|---|---|---|---|---|
| TFR2 | AD-52564 | 239 | A-108813.3 | cAGGcAGcCAAAcCuCAuUdTsdT | 35 | A-108816.3 | AAuGAGGUuUGGCUGcCugdTsdT | 38 |
| TFR2 | AD-52569 | 239 | A-108814.1 | cAGGcAGcCAAAcCuCAuUdTsdT | 35 | A-108810.5 | AAUGAGGUuUGGCuGcCuGdTsdT | 38 |
| TFR2 | AD-52570 | 239 | A-108814.3 | cAGGcAGcCAAAcCuCAuUdTsdT | 35 | A-108816.4 | AAuGAGGUuUGGCUGcCugdTsdT | 38 |
| TFR2 | AD-52574 | 239 | A-99598.2 | cAGGcAGccAAAccucAuudTsdT | 35 | A-108807.1 | AAUGAGGUUUGGCUGCCuGdTsdT | 38 |
| TFR2 | AD-52575 | 239 | A-108811.2 | cAGGcAGccAAAccucAuUdTsdT | 35 | A-108815.1 | AAUGAGGUuUGGCUGcCugdTsdT | 38 |
| TFR2 | AD-52579 | 239 | A-99598.3 | cAGGcAGccAAAccucAuudTsdT | 35 | A-108808.1 | AAUGAGGUUUGGCUGcCuGdTsdT | 38 |
| TFR2 | AD-52580 | 239 | A-108812.2 | cAGGcAGccAAAccucAuUdTsdT | 35 | A-108815.2 | AAUGAGGUuUGGCUGcCugdTsdT | 38 |
| TFR2 | AD-52584 | 239 | A-99598.4 | cAGGcAGccAAAccucAuudTsdT | 35 | A-108809.1 | AAUGAGGUUUGGCuGcCuGdTsdT | 38 |
| TFR2 | AD-52585 | 239 | A-108813.2 | cAGGcAGccAAAccucAuUdTsdT | 35 | A-108815.3 | AAUGAGGUuUGGCUGcCugdTsdT | 38 |
| TFR2 | AD-52589 | 239 | A-99598.5 | cAGGcAGccAAAccucAuudTsdT | 35 | A-108810.1 | AAUGAGGUUUGGCuGcCuGdTsdT | 38 |
| TFR2 | AD-52590 | 239 | A-108814.2 | cAGGcAGcCAAAcCuCAuUdTsdT | 35 | A-108815.4 | AAUGAGGUuUGGCUGcCugdTsdT | 38 |

It should be noted that unmodified versions of each of the modified sequences shown are included within the scope of the invention.

TABLE 14

TFR2 Dose Response

| Target | Reactivity | Duplex Name | Start Position | IC50 (nM) |
|---|---|---|---|---|
| TFR2 | Human | AD-47814 | 64 | 0.019 |
| TFR2 | Human | AD-52549 | 64 | 0.034 |
| TFR2 | Human | AD-52572 | 64 | 0.059 |
| TFR2 | Human | AD-52550 | 64 | 0.062 |
| TFR2 | Human | AD-52573 | 64 | 0.102 |
| TFR2 | Human | AD-52570 | 239 | 0.035 |
| TFR2 | Human | AD-47826 | 239 | 0.036 |
| TFR2 | Human | AD-52590 | 239 | 0.038 |
| TFR2 | Human | AD-52574 | 239 | 0.065 |
| TFR2 | Human | AD-52558 | 239 | 0.236 |

TABLE 15

SMAD4 Unmodified Duplexes

| Duplex Name | Start | Target | Sense Oligo Name | Trans Seq | SEQ ID NO: | Antis Oligo Name | Trans Seq | SEQ ID NO: |
|---|---|---|---|---|---|---|---|---|
| AD-48090.1 | 481 | SMAD4 | A-100350.1 | AUGCCUGUCUGAGCAUUGU | 884 | A-100351.1 | ACAAUGCUCAGACAGGCAU | 929 |
| AD-48091.1 | 772 | SMAD4 | A-100366.1 | AUGUUAAAUAUUGUCAGUA | 885 | A-100367.1 | UACUGACAAUAUUUAACAU | 930 |
| AD-48092.1 | 817 | SMAD4 | A-100382.1 | UCUGUGUGAAUCCAUAUCA | 886 | A-100383.1 | UGAUAUGGAUUCACACAGA | 931 |
| AD-48093.1 | 1212 | SMAD4 | A-100398.1 | ACUUACCAUCAUAACAGCA | 887 | A-100399.1 | UGCUGUUAUGAUGGUAAGU | 932 |
| AD-48094.1 | 1351 | SMAD4 | A-100414.1 | ACAAUGAGCUUGCAUUCCA | 888 | A-100415.1 | UGGAAUGCAAGCUCAUUGU | 933 |
| AD-48095.1 | 1712 | SMAD4 | A-100430.1 | UGUUCAUAAGAUCUACCCA | 889 | A-100431.1 | UGGGUAGAUCUUAUGAACA | 934 |

TABLE 15-continued

SMAD4 Unmodified Duplexes

| Duplex Name | Start | Target | Sense Oligo Name | Trans Seq | SEQ ID NO: | Antis Oligo Name | Trans Seq | SEQ ID NO: |
|---|---|---|---|---|---|---|---|---|
| AD-48096.1 | 590 | SMAD4 | A-100352.1 | AAAAGAUGAAUUGGAUUCU | 890 | A-100353.1 | AGAAUCCAAUUCAUCUUUU | 935 |
| AD-48097.1 | 773 | SMAD4 | A-100368.1 | UGUUAAAUAUUGUCAGUAU | 891 | A-100369.1 | AUACUGACAAUAUUUAACA | 936 |
| AD-48098.1 | 819 | SMAD4 | A-100384.1 | UGUGUGAAUCCAUAUCACU | 892 | A-100385.1 | AGUGAUAUGGAUUCACACA | 937 |
| AD-48099.1 | 1232 | SMAD4 | A-100400.1 | UACCACCUGGACUGGAAGU | 893 | A-100401.1 | ACUUCCAGUCCAGGUGGUA | 938 |
| AD-48100.1 | 1362 | SMAD4 | A-100416.1 | GCAUUCCAGCCUCCCAUUU | 894 | A-100417.1 | AAAUGGGAGGCUGGAAUGC | 939 |
| AD-48101.1 | 1713 | SMAD4 | A-100432.1 | GUUCAUAAGAUCUACCCAA | 895 | A-100433.1 | UUGGGUAGAUCUUAUGAAC | 940 |
| AD-48102.1 | 602 | SMAD4 | A-100354.1 | GGAUUCUUUAAUAACAGCU | 896 | A-100355.1 | AGCUGUUAUUAAAGAAUCC | 941 |
| AD-48103.1 | 777 | SMAD4 | A-100370.1 | AAAUAUUGUCAGUAUGCGU | 897 | A-100371.1 | ACGCAUACUGACAAUAUUU | 942 |
| AD-48104.1 | 820 | SMAD4 | A-100386.1 | GUGUGAAUCCAUAUCACUA | 898 | A-100387.1 | UAGUGAUAUGGAUUCACAC | 943 |
| AD-48105.1 | 1238 | SMAD4 | A-100402.1 | CUGGACUGGAAGUAGGACU | 899 | A-100403.1 | AGUCCUACUUCCAGUCCAG | 944 |
| AD-48106.1 | 1367 | SMAD4 | A-100418.1 | CCAGCCUCCCAUUUCCAAU | 900 | A-100419.1 | AUUGGAAAUGGGAGGCUGG | 945 |
| AD-48107.1 | 2816 | SMAD4 | A-100434.1 | UAUUUCUAGGCACAAGGUU | 901 | A-100435.1 | AACCUUGUGCCUAGAAAUA | 946 |
| AD-48108.1 | 608 | SMAD4 | A-100356.1 | UUUAAUAACAGCUAUAACU | 902 | A-100357.1 | AGUUAUAGCUGUUAUUAAA | 947 |
| AD-48109.1 | 778 | SMAD4 | A-100372.1 | AAUAUUGUCAGUAUGCGUU | 903 | A-100373.1 | AACGCAUACUGACAAUAUU | 948 |
| AD-48110.1 | 861 | SMAD4 | A-100388.1 | AUUGAUCUCUCAGGAUUAA | 904 | A-100389.1 | UUAAUCCUGAGAGAUCAAU | 949 |
| AD-48111.1 | 1250 | SMAD4 | A-100404.1 | UAGGACUGCACCAUACACA | 905 | A-100405.1 | UGUGUAUGGUGCAGUCCUA | 950 |
| AD-48112.1 | 1370 | SMAD4 | A-100420.1 | GCCUCCCAUUUCCAAUCAU | 906 | A-100421.1 | AUGAUUGGAAAUGGGAGGC | 951 |
| AD-48113.1 | 2984 | SMAD4 | A-100436.1 | AAUAUUUUGGAAACUGCUA | 907 | A-100437.1 | UAGCAGUUUCCAAAAUAUU | 952 |
| AD-48114.1 | 611 | SMAD4 | A-100358.1 | AAUAACAGCUAUAACUACA | 908 | A-100359.1 | UGUAGUUAUAGCUGUUAUU | 953 |
| AD-48115.1 | 781 | SMAD4 | A-100374.1 | AUUGUCAGUAUGCGUUUGA | 909 | A-100375.1 | UCAAACGCAUACUGACAAU | 954 |
| AD-48116.1 | 1090 | SMAD4 | A-100390.1 | CUGUGGCUUCCACAAGUCA | 910 | A-100391.1 | UGACUUGUGGAAGCCACAG | 955 |
| AD-48117.1 | 1257 | SMAD4 | A-100406.1 | GCACCAUACACACCUAAUU | 911 | A-100407.1 | AAUUAGGUGUGUAUGGUGC | 956 |
| AD-48118.1 | 1601 | SMAD4 | A-100422.1 | GUUGGAAUGUAAAGGUGAA | 912 | A-100423.1 | UUCACCUUUACAUUCCAAC | 957 |
| AD-48119.1 | 3013 | SMAD4 | A-100438.1 | UAAAUACUGUGCAGAAUAA | 913 | A-100439.1 | UUAUUCUGCACAGUAUUUA | 958 |
| AD-48120.1 | 659 | SMAD4 | A-100360.1 | CAUACAGAGAACAUUGGAU | 914 | A-100361.1 | AUCCAAUGUUCUCUGUAUG | 959 |

TABLE 15-continued

SMAD4 Unmodified Duplexes

| Duplex Name | Start | Target | Sense Oligo Name | Trans Seq | SEQ ID NO: | Antis Oligo Name | Trans Seq | SEQ ID NO: |
|---|---|---|---|---|---|---|---|---|
| AD-48121.1 | 783 | SMAD4 | A-100376.1 | UGUCAGUAUGCGUUUGACU | 915 | A-100377.1 | AGUCAAACGCAUACUGACA | 960 |
| AD-48122.1 | 1137 | SMAD4 | A-100392.1 | AGUGAAGGACUGUUGCAGA | 916 | A-100393.1 | UCUGCAACAGUCCUUCACU | 961 |
| AD-48123.1 | 1262 | SMAD4 | A-100408.1 | AUACACACCUAAUUUGCCU | 917 | A-100409.1 | AGGCAAAUUAGGUGUGUAU | 962 |
| AD-48124.1 | 1633 | SMAD4 | A-100424.1 | UCAGGUGCCUUAGUGACCA | 918 | A-100425.1 | UGGUCACUAAGGCACCUGA | 963 |
| AD-48125.1 | 698 | SMAD4 | A-100362.1 | UCGGAAAGGAUUUCCUCAU | 919 | A-100363.1 | AUGAGGAAAUCCUUUCCGA | 964 |
| AD-48126.1 | 784 | SMAD4 | A-100378.1 | GUCAGUAUGCGUUUGACUU | 920 | A-100379.1 | AAGUCAAACGCAUACUGAC | 965 |
| AD-48126.2 | 784 | SMAD4 | A-100378.2 | GUCAGUAUGCGUUUGACUU | 920 | A-100379.2 | AAGUCAAACGCAUACUGAC | 965 |
| AD-48127.1 | 1207 | SMAD4 | A-100394.1 | CAGCUACUUACCAUCAUAA | 921 | A-100395.1 | UUAUGAUGGUAAGUAGCUG | 966 |
| AD-48128.1 | 1272 | SMAD4 | A-100410.1 | AAUUUGCCUCACCACCAAA | 922 | A-100411.1 | UUUGGUGGUGAGGCAAAUU | 967 |
| AD-48129.1 | 1650 | SMAD4 | A-100426.1 | CACGCGGUCUUUGUCAAGA | 923 | A-100427.1 | UCUUGACAAAGACCGCGUG | 968 |
| AD-48130.1 | 771 | SMAD4 | A-100364.1 | CAUGUUAAAUAUUGUCAGU | 924 | A-100365.1 | AUCGACAAUAUUUAACAUG | 969 |
| AD-48131.1 | 791 | SMAD4 | A-100380.1 | UGCGUUUGACUUAAAAUGU | 925 | A-100381.1 | ACAUUUUAAGUCAAACGCA | 970 |
| AD-48132.1 | 1209 | SMAD4 | A-100396.1 | GCUACUUACCAUCAUAACA | 926 | A-100397.1 | UGUUAUGAUGGUAAGUAGC | 971 |
| AD-48133.1 | 1273 | SMAD4 | A-100412.1 | AUUUGCCUCACCACCAAAA | 927 | A-100413.1 | UUUUGGUGGUGAGGCAAAU | 972 |
| AD-48134.1 | 1652 | SMAD4 | A-100428.1 | CGCGGUCUUUGUACAGAGU | 928 | A-100429.1 | ACUCUGUACAAAGACCGCG | 973 |

Note
that an overhang (e.g. TT, dTsdT) can be added to the 3'end of any duplex.

TABLE 16

SMAD4 Modified Duplexes

| Target | Duplex Name | Start | Sense Oligo Name | Oligo Seq | SEQ ID NO: | Antis Oligo Name | Oligo Seq | SEQ ID NO: |
|---|---|---|---|---|---|---|---|---|
| SMAD4 | AD-48090.1 | 481 | A-100350.1 | AuGccuGucuGAGcAuuGudTsdT | 974 | A-100351.1 | AcAAUGCUcAGAcAGGcAUdTsdT | 1020 |
| SMAD4 | AD-48091.1 | 772 | A-100366.1 | AuGuuAAAuAuuGucAGuAdTsdT | 975 | A-100367.1 | uACUGAcAAuAUUuAAcAUdTsdT | 1021 |
| SMAD4 | AD-48092.1 | 817 | A-100382.1 | ucuGuGuGAAuccAuAucAdTsdT | 976 | A-100383.1 | UGAuAUGGAUUcAcAcAGAdTsdT | 1022 |
| SMAD4 | AD-48093.1 | 1212 | A-100398.1 | AcuuAccAucAuAAcAGcAdTsdT | 977 | A-100399.1 | UGCUGUuAUGAUGGuAAGUdTsdT | 1023 |
| SMAD4 | AD-48094.1 | 1351 | A-100414.1 | AcAAuGAGcuuGcAuuccAdTsdT | 978 | A-100415.1 | UGGAAUGcAAGCUcAUUGUdTsdT | 1024 |
| SMAD4 | AD-48095.1 | 1712 | A-100430.1 | uGuucAuAAGAucuAcccAdTsdT | 979 | A-100431.1 | UGGGuAGAUCUuAUGAAcAdTsdT | 1025 |

TABLE 16-continued

SMAD4 Modified Duplexes

| Target | Duplex Name | Start | Sense Oligo Name | Oligo Seq | SEQ ID NO: | Antis Oligo Name | Oligo Seq | SEQ ID NO: |
|---|---|---|---|---|---|---|---|---|
| SMAD4 | AD-48096.1 | 590 | A-100352.1 | AAAAGAuGAAuuGGAuucudTsdT | 980 | A-100353.1 | AGAAUCcAAUUcAUCUUUUdTsdT | 1026 |
| SMAD4 | AD-48097.1 | 773 | A-100368.1 | uGuuAAAuAuuGucAGuAudTsdT | 981 | A-100369.1 | AuACUGAcAAuAUUuAAcAdTsdT | 1027 |
| SMAD4 | AD-48098.1 | 819 | A-100384.1 | uGuGuGAAuccAuAucAcudTsdT | 982 | A-100385.1 | AGUGAuAUGGAUUcAcAcAdTsdT | 1028 |
| SMAD4 | AD-48099.1 | 1232 | A-100400.1 | uAccAccuGGAcuGGAAGudTsdT | 983 | A-100401.1 | ACUUCcAGUCcAGGUGGuAdTsdT | 1029 |
| SMAD4 | AD-48100.1 | 1362 | A-100416.1 | GcAuuccAGccucccAuuudTsdT | 984 | A-100417.1 | AAAUGGGAGGCUGGAAUGCdTsdT | 1030 |
| SMAD4 | AD-48101.1 | 1713 | A-100432.1 | GuucAuAAGAucuAcccAAdTsdT | 985 | A-100433.1 | UUGGGuAGAUCUuAUGAACdTsdT | 1031 |
| SMAD4 | AD-48102.1 | 602 | A-100354.1 | GGAuucuuuAAuAAcAGcudTsdT | 986 | A-100355.1 | AGCUGUuAUuAAAGAAUCCdTsdT | 1032 |
| SMAD4 | AD-48103.1 | 777 | A-100370.1 | AAAuAuuGucAGuAuGcGudTsdT | 987 | A-100371.1 | ACGcAuACUGAcAAuAUUUdTsdT | 1033 |
| SMAD4 | AD-48104.1 | 820 | A-100386.1 | GuGuGAAuccAuAucAcuAdTsdT | 988 | A-100387.1 | uAGUGAuAUGGAUUcAcAcAdTsdT | 1034 |
| SMAD4 | AD-48105.1 | 1238 | A-100402.1 | cuGGAcuGGAAGuAGGAcudTsdT | 989 | A-100403.1 | AGUCCuACUUCcAGUCcAGdTsdT | 1035 |
| SMAD4 | AD-48106.1 | 1367 | A-100418.1 | ccAGccucccAuuuccAAudTsdT | 990 | A-100419.1 | AUUGGAAAUGGGAGGCUGGdTsdT | 1036 |
| SMAD4 | AD-48107.1 | 2816 | A-100434.1 | uAuuucuAGGcAcAAGGuudTsdT | 991 | A-100435.1 | AACCUUGUGCCuAGAAAuAdTsdT | 1037 |
| SMAD4 | AD-48108.1 | 608 | A-100356.1 | uuuAAuAAcAGcuAuAAcudTsdT | 992 | A-100357.1 | AGUuAuAGCUGUuAUuAAAdTsdT | 1038 |
| SMAD4 | AD-48109.1 | 778 | A-100372.1 | AAuAuuGucAGuAuGcGuudTsdT | 993 | A-100373.1 | AACGcAuACUGAcAAuAUUdTsdT | 1039 |
| SMAD4 | AD-48110.1 | 861 | A-100388.1 | AuuGAucucucAGGAuuAAdTsdT | 994 | A-100389.1 | UuAAUCCUGAGAGAUcAAUdTsdT | 1040 |
| SMAD4 | AD-48111.1 | 1250 | A-100404.1 | uAGGAcuGcAccAuAcAcAdTsdT | 995 | A-100405.1 | UGUGuAUGGUGcAGUCCuAdTsdT | 1041 |
| SMAD4 | AD-48112.1 | 1370 | A-100420.1 | GccucccAuuuccAAucAudTsdT | 996 | A-100421.1 | AUGAUUGGAAAUGGGAGGCdTsdT | 1042 |
| SMAD4 | AD-48113.1 | 2984 | A-100436.1 | AAuAuuuuGGAAAcuGcuAdTsdT | 997 | A-100437.1 | uAGcAGUCCCcAAAAuAUUdTsdT | 1043 |
| SMAD4 | AD-48114.1 | 611 | A-100358.1 | AAuAAcAGcuAuAAcuAcAdTsdT | 998 | A-100359.1 | UGuAGUuAuAGCUGUuAUUdTsdT | 1044 |
| SMAD4 | AD-48115.1 | 781 | A-100374.1 | AuuGucAGuAuGcGuuuGAdTsdT | 999 | A-100375.1 | UcAAACGcAuACUGAcAAUdTsdT | 1045 |
| SMAD4 | AD-48116.1 | 1090 | A-100390.1 | cuGuGGcuuccAcAAGucAdTsdT | 1000 | A-100391.1 | UGACUUGUGGAAGCcAcAGdTsdT | 1046 |
| SMAD4 | AD-48117.1 | 1257 | A-100406.1 | GcAccAUaCaCaccuAAuudTsdT | 1001 | A-100407.1 | AAUuAGGUGUGuAUGGUGCdTsdT | 1047 |
| SMAD4 | AD-48118.1 | 1601 | A-100422.1 | GuuGGAAuGuAAAGGuGAAdTsdT | 1002 | A-100423.1 | UUcACCUUuAcAUUCcAACdTsdT | 1048 |
| SMAD4 | AD-48119.1 | 3013 | A-100438.1 | uAAAuAcuGuGcAGAAuAAdTsdT | 1003 | A-100439.1 | UuAUUCUGcAcAGuAUUuAdTsdT | 1049 |
| SMAD4 | AD-48120.1 | 659 | A-100360.1 | cAuAcAGAGAAcAuuGGAudTsdT | 1004 | A-100361.1 | AUCcAAUGUUCUCUGuAUGdTsdT | 1050 |

TABLE 16-continued

SMAD4 Modified Duplexes

| Target | Duplex Name | Start | Sense Oligo Name | Oligo Seq | SEQ ID NO: | Antis Oligo Name | Oligo Seq | SEQ ID NO: |
|---|---|---|---|---|---|---|---|---|
| SMAD4 | AD-48121.1 | 783 | A-100376.1 | uGucAGuAuGcGuuuGAcudTsdT | 1005 | A-100377.1 | AGUcAAACGcAuACUGAcAdTsdT | 1051 |
| SMAD4 | AD-48122.1 | 1137 | A-100392.1 | AGuGAAGGAcuGuuGcAGAdTsdT | 1006 | A-100393.1 | UCUGcAAcAGUCCUUcACUdTsdT | 1052 |
| SMAD4 | AD-48123.1 | 1262 | A-100408.1 | AuAcAcAccuAAuuuGccudTsdT | 1007 | A-100409.1 | AGGcAAAUuAGGUGUGuAUdTsdT | 1053 |
| SMAD4 | AD-48124.1 | 1633 | A-100424.1 | ucAGGuGccuuAGuGAccAdTsdT | 1008 | A-100425.1 | UGGUcACuAAGGcACCUGAdTsdT | 1054 |
| SMAD4 | AD-48125.1 | 698 | A-100362.1 | ucGGAAAGGAuuuccucAudTsdT | 1009 | A-100363.1 | AUGAGGAAAUCCUUUCCGAdTsdT | 1055 |
| SMAD4 | AD-48126.1 | 784 | A-100378.1 | GucAGuAuGcGuuuGAcuudTsdT | 1010 | A-100379.1 | AAGUcAAACGcAuACUGAcdTsdT | 1056 |
| SMAD4 | AD-48126.2 | 784 | A-100378.2 | GucAGuAuGcGuuuGAcuudTsdT | 1011 | A-100379.2 | AAGUcAAACGcAuACUGAcdTsdT | 1057 |
| SMAD4 | AD-48127.1 | 1207 | A-100394.1 | cAGcuAcuuAccAucAuAAdTsdT | 1012 | A-100395.1 | UuAUGAUGGuAAGuAGCUGdTsdT | 1058 |
| SMAD4 | AD-48128.1 | 1272 | A-100410.1 | AAuuuGccucAccAccAAAdTsdT | 1013 | A-100411.1 | UUUGGUGGUGAGGcAAAUUdTsdT | 1059 |
| SMAD4 | AD-48120.1 | 1650 | A-100426.1 | cAcGcGGucuuuGuAcAGAdTsdT | 1014 | A-100427.1 | UCUGuAcAAAGACCGCGUGdTsdT | 1060 |
| SMAD4 | AD-48130.1 | 771 | A-100364.1 | cAuGuuAAAuAuuGucAGudTsdT | 1015 | A-100365.1 | ACUGAcAAuAUUuAAcAUGdTsdT | 1061 |
| SMAD4 | AD-48131.1 | 791 | A-100380.1 | uGcGuuuGAcuuAAAAuGudTsdT | 1016 | A-100381.1 | AcAUUUuAAGUcAAACGcAdTsdT | 1062 |
| SMAD4 | AD-48132.1 | 1209 | A-100396.1 | GcuAcuuAccAucAuAAcAdTsdT | 1017 | A-100397.1 | UGUuAUGAUGGuAAGuAGCdTsdT | 1063 |
| SMAD4 | AD-48133.1 | 1273 | A-100412.1 | AuuuGccucAccAccAAAAdTsdT | 1018 | A-100413.1 | UUUUGGUGGUGAGGcAAAUdTsdT | 1064 |
| SMAD4 | AD-48134.1 | 1652 | A-100428.1 | cGcGGucuuuGuAcAGAGudTsdT | 1019 | A-100429.1 | ACUCUGuAcAAAGACCGCGdTsdT | 1065 |

It should be noted that unmodified versions of each of the modified sequences shown are included within the scope of the invention.

TABLE 17

NEO1 Unmodified Duplexes

| Target | Duplex Name | Start | Sense OligoName | Trans Seq | SEQ ID NO: | Antis Oligo Name | Trans Seq | SEQ ID NO: |
|---|---|---|---|---|---|---|---|---|
| NEO1 | AD-48273.1 | 4618 | A-100622.1 | CUCCGAGAGUAGCUAUGAA | 1066 | A-100623.1 | UUCAUAGCUACUCUCGGAG | 1110 |
| NEO1 | AD-48287.1 | 546 | A-100564.1 | GCUCUUCUGUUAUAUUAAA | 1067 | A-100565.1 | UUUAAUAUAACAGAAGAGC | 1111 |
| NEO1 | AD-48274.1 | 5060 | A-100638.1 | GAGUGUAGACAUUGGCAUU | 1068 | A-100639.1 | AAUGCCAAUGUCUACACUC | 1112 |
| NEO1 | AD-48309.1 | 4778 | A-100634.1 | GGAAUUGUACAGAGUACGA | 1069 | A-100635.1 | UCGUACUCUGUACAAUUCC | 1113 |
| NEO1 | AD-48309.2 | 4778 | A-100634.2 | GGAAUUGUACAGAGUACGA | 1070 | A-100635.2 | UCGUACUCUGUACAAUUCC | 1114 |
| NEO1 | AD-48297.1 | 4674 | A-100630.1 | GACUAAUGAAGGACCUAAA | 1071 | A-100631.1 | UUUAGGUCCUUCAUUAGUC | 1115 |

TABLE 17-continued

NEO1 Unmodified Duplexes

| Target | Duplex Name | Start | Sense OligoName | Trans Seq | SEQ ID NO: | Antis Oligo Name | Trans Seq | SEQ ID NO: |
|---|---|---|---|---|---|---|---|---|
| NEO1 | AD-48296.1 | 4495 | A-100614.1 | GAACCAUCACAUUCACUCA | 1072 | A-100615.1 | UGAGUGAAUGUGAUGGUUC | 1116 |
| NEO1 | AD-48280.1 | 5062 | A-100640.1 | GUGUAGACAUUGGCAUUUA | 1073 | A-100641.1 | UAAAUGCCAAUGUCUACAC | 1117 |
| NEO1 | AD-48275.1 | 535 | A-100560.1 | CUCAGUUAGAGGCUCUUCU | 1074 | A-100561.1 | AGAAGAGCCUCUAACUGAG | 1118 |
| NEO1 | AD-48276.1 | 1283 | A-100576.1 | GAUGAUGCUGGGACUUAUU | 1075 | A-100577.1 | AAUAAGUCCCAGCAUCAUC | 1119 |
| NEO1 | AD-48269.1 | 533 | A-100558.1 | CUCUCAGUUAGAGGCUCUU | 1075 | A-100559.1 | AAGAGCCUCUAACUGAGAG | 1120 |
| NEO1 | AD-48286.1 | 5069 | A-100642.1 | CAUUGGCAUUUAUGUACAA | 1077 | A-100643.1 | UUGUACAUAAAUGCCAAUG | 1121 |
| NEO1 | AD-48299.1 | 791 | A-100568.1 | GCAGGUCUUCCAAGAUUUA | 1078 | A-100569.1 | UAAAUCUUGGAAGACCUGC | 1122 |
| NEO1 | AD-48295.1 | 2602 | A-100598.1 | CCUAGAUGAAACUCGUGUU | 1079 | A-100599.1 | AACACGAGUUUCAUCUAGG | 1123 |
| NEO1 | AD-48292.1 | 5329 | A-100644.1 | GCAUUGCUGUUUGUAAGCU | 1080 | A-100645.1 | AGCUUACAAACAGCAAUGC | 1124 |
| NEO1 | AD-48293.1 | 686 | A-100566.1 | GUGGUGCAUUCCAAACACA | 1081 | A-100567.1 | UGUGUUUGGAAUGCACCAC | 1125 |
| NEO1 | AD-48288.1 | 1535 | A-100580.1 | GUUUUGGGUCUGGUGAAAU | 1082 | A-100581.1 | AUUUCACCAGACCCAAAAC | 1126 |
| NEO1 | AD-48307.1 | 4066 | A-100602.1 | GCCUGUGAUUAGUGCCCAU | 1083 | A-100603.1 | AUGGGCACUAAUCACAGGC | 1127 |
| NEO1 | AD-48270.1 | 1282 | A-100574.1 | GGAUGAUGCUGGGACUUAU | 1084 | A-100575.1 | AUAAGUCCCAGCAUCAUCC | 1128 |
| NEO1 | AD-48300.1 | 1949 | A-100584.1 | GCUCAAAAUAAGCAUGGCU | 1085 | A-100585.1 | AGCCAUGCUUAUUUUGAGC | 1129 |
| NEO1 | AD-48306.1 | 2227 | A-100586.1 | CCGAGUGGUGGCCUACAAU | 1086 | A-100578.1 | AUUGUAGGCCACCACUCGG | 1130 |
| NEO1 | AD-48315.1 | 5059 | A-100636.1 | GGAGUGUAGACAUUGGCAU | 1087 | A-100637.1 | AUGCCAAUGUCUACACUCC | 1131 |
| NEO1 | AD-48291.1 | 4673 | A-100628.1 | GGACUAAUGAAGGACCUAA | 1088 | A-100629.1 | UUAGGUCCUUCAUUAGUCC | 1132 |
| NEO1 | AD-48272.1 | 4096 | A-100606.1 | CCUCGAUAACCCUCACCAU | 1089 | A-100607.1 | AUGGUGAGGGUUAUCGAGG | 1133 |
| NEO1 | AD-48271.1 | 2273 | A-100590.1 | GAUGUUGCUGUUCGAACAU | 1090 | A-100591.1 | AUGUUCGAACAGCAACAUC | 1134 |
| NEO1 | AD-48294.1 | 1540 | A-100582.1 | GGGUCUGGUGAAAUCAGAU | 1091 | A-100583.1 | AUCUGAUUUCACCAGACCC | 1135 |
| NEO1 | AD-48278.1 | 4123 | A-100608.1 | CUCCAGCAGCCUCGCUUCU | 1092 | A-100609.1 | AGAAGCGAGGCUGCUGGAG | 1136 |
| NEO1 | AD-48277.1 | 2312 | A-100592.1 | GCUCCUCAGAAUCUGUCCU | 1093 | A-100593.1 | AGGACAGAUUCUGAGGAGC | 1137 |
| NEO1 | AD-48313.1 | 4086 | A-100604.1 | CCAUCCAUUCCCUCGAUAA | 1094 | A-100605.1 | UUAUCGAGGGAAUGGAUGG | 1138 |
| NEO1 | AD-48289.1 | 2484 | A-100596.1 | CUCAGCUGAUUGAAGGUCU | 1095 | A-100597.1 | AGACCUUCAAUCAGCUGAG | 1139 |
| NEO1 | AD-48290.1 | 4179 | A-100612.1 | GGCCCAUUGGCACAUCCAU | 1096 | A-100613.1 | AUGGAUGUGCCAAUGGGCC | 1140 |

TABLE 17-continued

NEO1 Unmodified Duplexes

| Target | Duplex Name | Sense Start | Oligo Name | Trans Seq | SEQ ID NO: | Antis Oligo Name | Trans Seq | SEQ ID NO: |
|---|---|---|---|---|---|---|---|---|
| NEO1 | AD-48284.1 | 4174 | A-100610.1 | CCCAUGGCCCAUUGGCACA | 1097 | A-100611.1 | UGUGCCAAUGGGCCAUGGG | 1141 |
| NEO1 | AD-48298.1 | 6731 | A-100646.1 | GUACCUGGAUACUGCCACA | 1098 | A-100647.1 | UGUGGCAGUAUCCAGGUAC | 1142 |
| NEO1 | AD-48311.1 | 852 | A-100572.1 | CAAUUCUGAAUUGUGAAGU | 1099 | A-100573.1 | ACUUCACAAUUCAGAAUUG | 1143 |
| NEO1 | AD-48285.1 | 4664 | A-100626.1 | CACCUGGAAGGACUAAUGA | 1100 | A-100627.1 | UCAUUAGUCCUUCCAGGUG | 1144 |
| NEO1 | AD-48282.1 | 1448 | A-100578.1 | CCAACUCCAACUGUGAAGU | 1101 | A-100579.1 | ACUUCACAGUUGGAGUUGG | 1145 |
| NEO1 | AD-48302.1 | 4542 | A-100616.1 | GAAGGAGCCGGCCUCCUAU | 1102 | A-100617.1 | AUAGGAGGCCGGCUCCUUC | 1146 |
| NEO1 | AD-48303.1 | 4767 | A-100632.1 | CUUGAAAACAAGGAAUUGU | 1103 | A-100633.1 | ACAAUUCCUUGUUUUCAAG | 1147 |
| NEO1 | AD-48279.1 | 4629 | A-100624.1 | GCUAUGAACCAGAUGAGCU | 1104 | A-100625.1 | AGCUCAUCUGGUUCAUAGC | 1148 |
| NEO1 | AD-48301.1 | 3361 | A-100600.1 | GAUACAUGACUGGGUUAUU | 1105 | A-100601.1 | AAUAACCCAGUCAUGUAUC | 1149 |
| NEO1 | AD-48314.1 | 4613 | A-100620.1 | GAAGACUCCGAGAGUAGCU | 1106 | A-100621.1 | AGCUACUCUCGGAGUCUUC | 1150 |
| NEO1 | AD-48312.1 | 2236 | A-100588.1 | GGCCUACAAUAAACAUGGU | 1107 | A-100589.1 | ACCAUGUUUAUUGUAGGCC | 1151 |
| NEO1 | AD-48304.1 | 7033 | A-100648.1 | GUACACACUUGUUUGGCUU | 1108 | A-100649.1 | AGGCCAAACAAGUGUGUAC | 1152 |
| NEO1 | AD-48310.1 | 7043 | A-100650.1 | GUUUGGCCUUUUCUGUAGU | 1109 | A-100651.1 | ACUACAGAAAAGGCCAAAC | 1153 |

Note that an overhang (e.g. TT, dTsdT) can be added to the 3'end of any duplex.

TABLE 18

NEO1 Modified Duplexes

| Duplex Name | Target | Sense Start | Oligo Name | Oligo Seq | SEQ ID NO: | Antis Oligo Name | Oligo Seq | SEQ ID NO: |
|---|---|---|---|---|---|---|---|---|
| AD-48273.1 | NEO1 | 4618 | A-100622.1 | cuccGAGAGuAGcuAuGAAdTsdT | 1154 | A-100623.1 | UUcAuAGCuACUCUCGGAGdTsdT | 1198 |
| AD-48287.1 | NEO1 | 546 | A-100564.1 | GcucuucuGuuAuAuuAAAdTsdT | 1155 | A-100565.1 | UUuAAuAuAAcAGAAGAGCdTsdT | 1199 |
| AD-48274.1 | NEO1 | 5060 | A-100638.1 | GAGuGuAGAcAuuGGcAuudTsdT | 1156 | A-100639.1 | AAUGCcAAUGUCuAcACUCdTsdT | 1200 |
| AD-48309.1 | NEO1 | 4778 | A-100634.1 | GGAAuuGuAcAGAGuAcGAdTsdT | 1157 | A-100635.1 | UCGuACUCUGuAcAAUUCCdTsdT | 1201 |
| AD-48309.2 | NEO1 | 4778 | A-100634.2 | GGAAuuGuAcAGAGuAcGAdTsdT | 1158 | A-100635.2 | UCGuACUCUGuAcAAUUCCdTsdT | 1202 |
| AD-48297.1 | NEO1 | 4674 | A-100630.1 | GAcuAAuGAAGGAccuAAAdTsdT | 1159 | A-100631.1 | UUuAGGUCCUUcAUuAGUCdTsdT | 1203 |
| AD-48296.1 | NEO1 | 4495 | A-100614.1 | GAAccAucAcAuucAcucAdTsdT | 1160 | A-100615.1 | UGAGUGAAUGUGAUGGUUCdTsdT | 1204 |
| AD-48280.1 | NEO1 | 5062 | A-100640.1 | GuGuAGAcAuuGcAuuuAdTsdT | 1161 | A-100641.1 | uAAAUGCcAAUGUCuAcACdTsdT | 1205 |

TABLE 18-continued

NEO1 Modified Duplexes

| Duplex Name | Target | Sense Start | Oligo Name | Oligo Seq | SEQ ID NO: | Antis Oligo Name | Oligo Seq | SEQ ID NO: |
|---|---|---|---|---|---|---|---|---|
| AD-48275.1 | NEO1 | 535 | A-100560.1 | cucAGuuAGAGG cucuucudTsdT | 1162 | A-100561.1 | AGAAGAGCCUCu AACUGAGdTsdT | 1206 |
| AD-48276.1 | NEO1 | 1283 | A-100576.1 | GAuGAuGcuGGG AcuuAuudTsdT | 1163 | A-100577.1 | AAuAAGUCCcAG cAUcAUCdTsdT | 1207 |
| AD-48269.1 | NEO1 | 533 | A-100558.1 | cucucAGuuAGA GGcucuudTsdT | 1164 | A-100559.1 | AAGAGCCUCuAA CUGAGAGdTsdT | 1208 |
| AD-48286.1 | NEO1 | 5069 | A-100642.1 | cAuuGGcAuuuA uGuAcAAdTsdT | 1165 | A-100643.1 | UUGuAcAuAAAU GCcAAUGdTsdT | 1209 |
| AD-48299.1 | NEO1 | 791 | A-100568.1 | GcAGGucuuccA AGAuuuAdTsdT | 1166 | A-100569.1 | uAAAUCUUGGAA GACCUGCdTsdT | 1210 |
| AD-48295.1 | NEO1 | 2602 | A-100598.1 | ccuAGAuGAAAc ucGuGuudTsdT | 1167 | A-100599.1 | AAcACGAGUUUc AUCuAGGdTsdT | 1211 |
| AD-48292.1 | NEO1 | 5329 | A-100644.1 | GcAuuGcuGuuu GuAAGcudTsdT | 1168 | A-100645.1 | AGCUuAcAAAcA GcAAUGCdTsdT | 1212 |
| AD-48293.1 | NEO1 | 686 | A-100566.1 | GuGGuGcAuucc AAAcAcAdTsdT | 1169 | A-100567.1 | UGUGUUUGGAAU GcACcACdTsdT | 1213 |
| AD-48288.1 | NEO1 | 1535 | A-100580.1 | GuuuuGGGucuG GuGAAAudTsdT | 1170 | A-100581.1 | AUUUcACcAGAC CcAAAACdTsdT | 1214 |
| AD-48307.1 | NEO1 | 4066 | A-100602.1 | GccuGuGAuuAG uGcccAudTsdT | 1171 | A-100603.1 | AUGGGcACuAAU cAcAGGCdTsdT | 1215 |
| AD-48270.1 | NEO1 | 1282 | A-100574.1 | GGAuGAuGcuGG GAcuuAudTsdT | 1172 | A-100575.1 | AuAAGUCCcAGc AUcAUCCdTsdT | 1216 |
| AD-48300.1 | NEO1 | 1949 | A-100584.1 | GcucAAAAuAAG cAuGGcudTsdT | 1173 | A-100585.1 | AGCcAUGCUuAU UUUGAGCdTsdT | 1217 |
| AD-48306.1 | NEO1 | 2227 | A-100586.1 | ccGAGuGGuGGc cuAcAAudTsdT | 1174 | A-100587.1 | AUUGuAGGCcAC cACUCGGdTsdT | 1218 |
| AD-48315.1 | NEO1 | 5059 | A-100636.1 | GGAGuGuAGAcA uuGGcAudTsdT | 1175 | A-100637.1 | AUGCcAAUGUCu AcACUCCdTsdT | 1219 |
| AD-48291.1 | NEO1 | 4673 | A-100628.1 | GGAcuAAuGAAG GAccuAAdTsdT | 1176 | A-100629.1 | UuAGGUCCUUcA UuAGUCCdTsdT | 1220 |
| AD-48272.1 | NEO1 | 4096 | A-100606.1 | ccucGAuAAccc ucAccAudTsdT | 1177 | A-100607.1 | AUGGUGAGGGUu AUCGAGGdTsdT | 1221 |
| AD-48271.1 | NEO1 | 2273 | A-100590.1 | GAuGuuGcuGuu cGAAcAudTsdT | 1178 | A-100591.1 | AUGUUCGAAcAG cAAcAUCdTsdT | 1222 |
| AD-48294.1 | NEO1 | 1540 | A-100582.1 | GGGucuGGuGAA AucAGAudTsdT | 1179 | A-100583.1 | AUCUGAUUUcAC cAGACCCdTsdT | 1223 |
| AD-48278.1 | NEO1 | 4123 | A-100608.1 | cuccAGcAGccu cGcuucudTsdT | 1180 | A-100609.1 | AGAAGCGAGGCU GCUGGAGdTsdT | 1224 |
| AD-48277.1 | NEO1 | 2312 | A-100592.1 | GcuccucAGAAu cuGuccudTsdT | 1181 | A-100593.1 | AGGAcAGAUUCU GAGGAGCdTsdT | 1225 |
| AD-48313.1 | NEO1 | 4086 | A-100604.1 | ccAuccAuuccc ucGAuAAdTsdT | 1182 | A-100605.1 | UuAUCGAGGGAA UGGAUGGdTsdT | 1226 |
| AD-48289.1 | NEO1 | 2484 | A-100596.1 | cucAGcuGAuuG AAGGucudTsdT | 1183 | A-100597.1 | AGACCUUcAAUc AGCUGAGdTsdT | 1227 |
| AD-48290.1 | NEO1 | 4179 | A-100612.1 | GGcccAuuGGcA cAuccAudTsdT | 1184 | A-100613.1 | AUGGAUGUGCcA AUGGGCCdTsdT | 1228 |
| AD-48284.1 | NEO1 | 4174 | A-100610.1 | cccAuGGcccAu uGGcAcAdTsdT | 1185 | A-100611.1 | UGUGCcAAUGGG CcAUGGGdTsdT | 1229 |
| AD-48298.1 | NEO1 | 6731 | A-100646.1 | GuAccuGGAuAc uGccAcAdTsdT | 1186 | A-100647.1 | UGUGGcAGuAUC cAGGuACdTsdT | 1230 |

TABLE 18-continued

NEO1 Modified Duplexes

| Duplex Name | Target | Start | Sense Oligo Name | Oligo Seq | SEQ ID NO: | Antis Oligo Name | Oligo Seq | SEQ ID NO: |
|---|---|---|---|---|---|---|---|---|
| AD-48311.1 | NEO1 | 852 | A-100572.1 | cAAuucuGAAuuGuGAAGudTsdT | 1187 | A-100573.1 | ACUUcAcAAUUcAGAAUUGdTsdT | 1231 |
| AD-48285.1 | NEO1 | 4664 | A-100626.1 | cAccuGGAAGGAcuAAuGAdTsdT | 1188 | A-100627.1 | UcAUuAGUCCUUCcAGGUGdTsdT | 1232 |
| AD-48282.1 | NEO1 | 1448 | A-100578.1 | ccAAcuccAAcuGuGAAGudTsdT | 1189 | A-100579.1 | ACUUcAcAGUUGGAGUUGGdTsdT | 1233 |
| AD-48302.1 | NEO1 | 4542 | A-100616.1 | GAAGGAGccGGccuccuAudTsdT | 1190 | A-100617.1 | AuAGGAGGCCGGCUCCUUCdTsdT | 1234 |
| AD-48303.1 | NEO1 | 4767 | A-100632.1 | cuuGAAAAcAAGGAAuuGudTsdT | 1191 | A-100633.1 | AcAAUUCCUUGUUUUcAAGdTsdT | 1235 |
| AD-48279.1 | NEO1 | 4629 | A-100624.1 | GcuAuGAAccAGAuGAGcudTsdT | 1192 | A-100625.1 | AGCUcAUCUGGUUcAuAGCdTsdT | 1236 |
| AD-48301.1 | NEO1 | 3361 | A-100600.1 | GAuAcAuGAcuGGGuuAuudTsdT | 1193 | A-100601.1 | AAuAACCcAGUcAUGuAUCdTsdT | 1237 |
| AD-48314.1 | NEO1 | 4613 | A-100620.1 | GAAGAcuccGAGAGuAGcudTsdT | 1194 | A-100621.1 | AGCuACUCUCGGAGUCUUCdTsdT | 1238 |
| AD-48312.1 | NEO1 | 2236 | A-100588.1 | GGccuAcAAuAAAcAuGGudTsdT | 1195 | A-100589.1 | ACcAUGUUuAUUGuAGGCCdTsdT | 1239 |
| AD-48304.1 | NEO1 | 7033 | A-100648.1 | GuAcAcAcuuGuuuGGccudTsdT | 1196 | A-100649.1 | AGGCcAAAcAAGUGUGuACdTsdT | 1240 |
| AD-48310.1 | NEO1 | 7043 | A-100650.1 | GuuuGGccuuuucuGuAGudTsdT | 1197 | A-100651.1 | ACuAcAGAAAAGGCcAAACdTsdT | 1241 |

It should be noted that unmodified versions of each of the modified sequences shown are included within the scope of the invention.

TABLE 19

SMAD4 Percent Inhibition

| Target | ID | 0.1 nM (% message remaining) | | 10 nM (% message remaning) | |
|---|---|---|---|---|---|
| | | Avg | SD | Avg | SD |
| SMAD4 | AD-48090 | 93.6 | 4.6 | 54.6 | 5.6 |
| SMAD4 | AD-48091 | 98.0 | 5.0 | 60.8 | 3.3 |
| SMAD4 | AD-48092 | 64.6 | 0.2 | 47.8 | 12.0 |
| SMAD4 | AD-48093 | 96.4 | 3.5 | 45.0 | 8.0 |
| SMAD4 | AD-48094 | 41.3 | 0.4 | 16.3 | 5.4 |
| SMAD4 | AD-48095 | 64.4 | 9.1 | 30.0 | 0.5 |
| SMAD4 | AD-48096 | 70.5 | 1.8 | 44.3 | 0.7 |
| SMAD4 | AD-48097 | 19.6 | 2.5 | 10.0 | 1.6 |
| SMAD4 | AD-48098 | 60.6 | 2.1 | 29.9 | 1.8 |
| SMAD4 | AD-48099 | 83.1 | 5.5 | 57.2 | 2.5 |
| SMAD4 | AD-48100 | 73.4 | 1.6 | 50.4 | 1.2 |
| SMAD4 | AD-48101 | 34.8 | 3.7 | 23.3 | 0.9 |
| SMAD4 | AD-48102 | 66.9 | 3.2 | 35.5 | 4.0 |
| SMAD4 | AD-48103 | 43.4 | 8.9 | 20.5 | 1.0 |
| SMAD4 | AD-48104 | 53.5 | 6.2 | 20.5 | 1.5 |
| SMAD4 | AD-48105 | 59.4 | 0.6 | 23.8 | 3.0 |
| SMAD4 | AD-48106 | 68.4 | 0.3 | 40.7 | 0.5 |
| SMAD4 | AD-48107 | 40.9 | 3.0 | 26.9 | 6.6 |
| SMAD4 | AD-48108 | 21.4 | 4.3 | 15.2 | 4.3 |
| SMAD4 | AD-48109 | 19.2 | 4.1 | 12.1 | 5.2 |
| SMAD4 | AD-48110 | 46.1 | 6.4 | 28.4 | 8.1 |
| SMAD4 | AD-48111 | 75.9 | 5.1 | 68.4 | 12.1 |
| SMAD4 | AD-48112 | 75.8 | 2.0 | 72.0 | 10.4 |
| SMAD4 | AD-48113 | 87.4 | 11.1 | 72.0 | 2.7 |
| SMAD4 | AD-48114 | 36.7 | 3.2 | 19.2 | 0.6 |
| SMAD4 | AD-48115 | 35.8 | 2.8 | 18.6 | 1.9 |
| SMAD4 | AD-48116 | 37.1 | 0.2 | 13.6 | 0.9 |
| SMAD4 | AD-48117 | 32.1 | 0.8 | 21.1 | 1.4 |
| SMAD4 | AD-48118 | 26.3 | 1.1 | 16.4 | 5.5 |
| SMAD4 | AD-48119 | 52.1 | 4.7 | 38.8 | 4.5 |
| SMAD4 | AD-48120 | 32.1 | 1.0 | 13.9 | 1.4 |
| SMAD4 | AD-48121 | 24.3 | 2.3 | 10.0 | 0.7 |
| SMAD4 | AD-48122 | 31.4 | 5.7 | 14.6 | 1.7 |
| SMAD4 | AD-48123 | 27.4 | 1.5 | 14.6 | 2.2 |
| SMAD4 | AD-48124 | 76.8 | 7.0 | 55.8 | 1.0 |
| SMAD4 | AD-48125 | 28.7 | 2.6 | 12.6 | 0.9 |
| SMAD4 | AD-48126 | 18.9 | 1.9 | 7.4 | 0.2 |
| SMAD4 | AD-48127 | 67.5 | 3.7 | 39.6 | 4.0 |
| SMAD4 | AD-48128 | 69.8 | 4.0 | 44.5 | 6.1 |
| SMAD4 | AD-48129 | 73.1 | 3.4 | 42.6 | 2.0 |
| SMAD4 | AD-48130 | 18.1 | 0.1 | 12.5 | 0.9 |
| SMAD4 | AD-48131 | 44.4 | 0.5 | 17.1 | 4.1 |
| SMAD4 | AD-48132 | 47.7 | 0.1 | 22.6 | 5.4 |
| SMAD4 | AD-48133 | 57.1 | 1.8 | 30.4 | 10.0 |
| SMAD4 | AD-48134 | 86.3 | 18.0 | 42.4 | 9.2 |

TABLE 20

NEO1 Percent Inhibition

| Target | ID | 0.1 nM (% message remaining) Avg | SD | 10 nM (% message remaining) Avg | SD |
|---|---|---|---|---|---|
| Neo1 | AD-48273 | 8.4 | 0.7 | 9.3 | 3.6 |
| Neo1 | AD-48287 | 8.6 | 5.5 | 10.4 | 2.7 |
| Neo1 | AD-48274 | 11.0 | 4.3 | 6.5 | 2.2 |
| Neo1 | AD-48309 | 11.0 | 0.6 | 6.5 | 0.8 |
| Neo1 | AD-48297 | 12.9 | 1.6 | 8.7 | 2.4 |
| Neo1 | AD-48296 | 14.0 | 6.9 | 7.6 | 0.1 |
| Neo1 | AD-48280 | 15.6 | 3.7 | 10.8 | 7.1 |
| Neo1 | AD-48275 | 17.7 | 6.9 | 8.4 | 3.8 |
| Neo1 | AD-48276 | 17.8 | 9.8 | 6.8 | 2.0 |
| Neo1 | AD-48269 | 18.4 | 5.5 | 10.9 | 4.4 |
| Neo1 | AD-48286 | 21.4 | 3.8 | 11.7 | 2.1 |
| Neo1 | AD-48299 | 22.9 | 3.0 | 11.7 | 3.8 |
| Neo1 | AD-48295 | 36.2 | 16.3 | 12.0 | 0.4 |
| Neo1 | AD-48292 | 44.3 | 6.8 | 14.8 | 2.2 |
| Neo1 | AD-48293 | 44.7 | 14.1 | 30.7 | 1.8 |
| Neo1 | AD-48288 | 46.9 | 21.9 | 31.9 | 5.2 |
| Neo1 | AD-48307 | 50.2 | 10.1 | 16.8 | 3.9 |
| Neo1 | AD-48270 | 54.2 | 10.6 | 65.9 | 42.5 |
| Neo1 | AD-48300 | 54.6 | 0.1 | 18.6 | 1.9 |
| Neo1 | AD-48306 | 56.6 | 19.5 | 16.0 | 2.3 |
| Neo1 | AD-48315 | 57.7 | 3.5 | 17.6 | 8.0 |
| Neo1 | AD-48291 | 60.2 | 12.0 | 35.2 | 6.4 |
| Neo1 | AD-48272 | 61.9 | 4.1 | 25.2 | 3.2 |
| Neo1 | AD-48271 | 62.6 | 4.7 | 35.4 | 6.8 |
| Neo1 | AD-48294 | 62.6 | 2.1 | 22.7 | 11.0 |
| Neo1 | AD-48278 | 62.9 | 13.8 | 27.4 | 1.3 |
| Neo1 | AD-48277 | 63.2 | 20.4 | 26.1 | 2.6 |
| Neo1 | AD-48313 | 68.2 | 18.7 | 43.7 | 2.2 |
| Neo1 | AD-48289 | 70.6 | 15.3 | 53.6 | 12.3 |
| Neo1 | AD-48290 | 73.8 | 22.6 | 60.0 | 3.9 |
| Neo1 | AD-48284 | 74.0 | 19.2 | 106.9 | 43.7 |
| Neo1 | AD-48298 | 76.0 | 6.9 | 75.4 | 19.3 |
| Neo1 | AD-48311 | 77.9 | 22.6 | 23.5 | 11.1 |
| Neo1 | AD-48285 | 81.0 | 11.5 | 65.3 | 14.2 |
| Neo1 | AD-48282 | 82.7 | 16.3 | 47.0 | 15.3 |
| Neo1 | AD-48302 | 83.3 | 3.1 | 32.8 | 6.7 |
| Neo1 | AD-48303 | 85.0 | 16.3 | 29.2 | 7.7 |
| Neo1 | AD-48279 | 90.2 | 6.2 | 51.7 | 14.3 |
| Neo1 | AD-48301 | 91.8 | 8.5 | 88.2 | 11.1 |
| Neo1 | AD-48314 | 96.7 | 16.7 | 128.8 | 37.8 |
| Neo1 | AD-48312 | 107.9 | 30.0 | 94.0 | 27.8 |
| Neo1 | AD-48304 | 111.6 | 22.3 | 91.6 | 33.2 |
| Neo1 | AD-48310 | 118.0 | 36.4 | 118.8 | 29.0 |

TABLE 21

BMP6 Duplexes

| duplexName | sOligoSeq | SEQ ID NO | asOligoSeq | SEQ ID NO | Set |
|---|---|---|---|---|---|
| AD-47955.1 | GcAGAAuuccGcAucuAcAdTsdT | 1242 | UGuAGAUGCGGAAUUCUGCdTsdT | 1300 | humanRhesus |
| AD-47957.1 | GAAuAuGGuuGuAAGAGcudTsdT | 1243 | AGCUCUuAcAACcAUAUUCdTsdT | 1301 | humanRhesus |
| AD-47966.1 | cucuucAuGcuGGAucuGudTsdT | 1244 | AcAGAUCcAGcAUGAAGAGdTsdT | 1302 | humanRhesus |
| AD-47989.1 | GAGuucAAGuucAAcuuAudTsdT | 1245 | AuAAGUUGAACUUGAACUCdTsdT | 1303 | humanRhesus |
| AD-47993.1 | cGuGAGuAGuuGuuGGucudTsdT | 1246 | AGACcAAcAACuACUcACGdTsdT | 1304 | humanRhesus |
| AD-47960.1 | GGAcGAccAuGAGAGAuAAdTsdT | 1247 | UuAUCUCUcAUGGUCGUCCdTsdT | 1305 | humanRhesus |
| AD-47997.1 | ccuAGAuuAcAucuGccuudTsdT | 1248 | AAGGcAGAUGuAAUCuAGGdTsdT | 1306 | humanRhesus |
| AD-47985.1 | cAAcAGAGucGuAAucGcAdTsdT | 1249 | AGCGAUuACGACUCUGUUGdTsdT | 1307 | humanRhesus |
| AD-47983.1 | GucuAucAAAGGuAGAuuudTsdT | 1250 | AAAUCuACCUUUGAuAGACdTsdT | 1308 | humanRhesus |
| AD-47954.1 | cccGGAcGAccAuGAGAGAdTsdT | 1251 | UCUCUcAUGGUCGUCCGGGdTsdT | 1309 | humanRhesus |
| AD-47972.1 | cucGucAGcGAcAccAcAAdTsdT | 1252 | UUGUGGUGUCGCUGACGAGdTsdT | 1310 | humanRhesus |
| AD-47981.1 | ccAcuAAcucGAAAccAGAdTsdT | 1253 | UCUGGUUUCGAGUuAGUGGdTsdT | 1311 | humanRhesus |
| AD-47982.1 | GuAAAuGAcGuGAGuAGuudTsdT | 1254 | AACuACUcACGUcAUUuACdTsdT | 1312 | humanRhesus |
| AD-47987.1 | GGGGAcAcAcAuucuGccudTsdT | 1255 | AGGcAGAAUGUGUGUCCCCdTsdT | 1313 | humanRhesus |
| AD-47994.1 | cGGcuGcAGAAuuccGcAudTsdT | 1256 | AUGCGGAAUUCUGcAGCCGdTsdT | 1314 | humanRhesus |
| AD-47973.1 | GccGAcAAcAGAGucGuAAdTsdT | 1257 | UuACGACUCUGUUGUCGGCdTsdT | 1315 | humanRhesus |
| AD-47975.1 | GGAuGccAcuAAcucGAAAdTsdT | 1258 | UUUCGAGUuAGUGGcAUCCdTsdT | 1316 | humanRhesus |
| AD-47979.1 | ccGAcAAcAGAGucGuAAudTsdT | 1259 | AUuACGACUCUGUUGUCGGdTsdT | 1317 | humanRhesus |
| AD-47996.1 | cGuGcuGuGcGccAAcuAAdTsdT | 1260 | UuAGUUGGCGcAcAGcACGdTsdT | 1318 | humanRhesus |
| AD-47968.1 | cAAcGcAcAcAuGAAuGcAdTsdT | 1261 | UGcAUUcAUGUGUGCGUUGdTsdT | 1319 | humanRhesus |

TABLE 21-continued

BMP6 Duplexes

| duplexName | sOligoSeq | SEQ ID NO | asOligoSeq | SEQ ID NO | Set |
| --- | --- | --- | --- | --- | --- |
| AD-47977.1 | cuGucuAucAAAGGuAGAudTsdT | 1262 | AUCuACCUUUGAuAGAcAGdTsdT | 1320 | humanRhesus |
| AD-47995.1 | GcGGGucuccAGuGcuucAdTsdT | 1263 | UGAAGcACUGGAGACCCGCdTsdT | 1321 | humanRhesus |
| AD-47959.1 | cuGAGuuuGGAuGucuGuAdTsdT | 1264 | uAcAGAcAUCcAAAcUcAGdTsdT | 1322 | humanRhesus |
| AD-47962.1 | cAGGAAGcAuGAGcuGuAudTsdT | 1265 | AuAcAGCUcAUGCUUCCUGdTsdT | 1323 | humanRhesus |
| AD-47967.1 | GGcuGGcuGGAAuuuGAcAdTsdT | 1266 | UGUcAAAUUCcAGCcAGCCdTsdT | 1324 | humanRhesus |
| AD-47986.1 | GcAGAccuuGGuucAccuudTsdT | 1267 | AAGGUGAACcAAGGUCUGCdTsdT | 1325 | humanRhesus |
| AD-47988.1 | GAcGuGAGuAGuuGuuGGudTsdT | 1268 | ACcAAcAACuACUcACGUCdTsdT | 1326 | humanRhesus |
| AD-47990.1 | cAGAGucGuAAucGcucuAdTsdT | 1269 | uAGAGCUGAuACGACUCUGdTsdT | 1327 | humanRhesus |
| AD-47991.1 | cAGAccuuGGuucAccuuAdTsdT | 1270 | uAAGGUGAACcAAGGUCUGdTsdT | 1328 | humanRhesus |
| AD-47956.1 | GGGucuccAGuGcuucAGdTsdT | 1271 | UCUGAAGcACUGGAGACCCdTsdT | 1329 | humanRhesus |
| AD-47974.1 | GcAcAcAuGAAuGcAAccAdTsdT | 1272 | UGGUUGcAUUcAUGUGUGCdTsdT | 1330 | humanRhesus |
| AD-47976.1 | GGuAAAuGAcGuGAGuAGudTsdT | 1273 | ACuACUcACGUcAUUuACCdTsdT | 1331 | humanRhesus |
| AD-47980.1 | cAcAcAuGAAuGcAAccAAdTsdT | 1274 | UUGGUUGcAUUcAUGUGUGdTsdT | 1332 | humanRhesus |
| AD-47984.1 | cGAcAccAcAAAGAGuucAdTsdT | 1275 | UGAACUCUUUGUGGUGUCGdTsdT | 1333 | humanRhesus |
| AD-47964.1 | cucAuuAAuAuuuGcucAdTsdT | 1276 | UGAGcAAAUuAUuAAUGAGdTsdT | 1334 | humanRhesus |
| AD-47970.1 | cAuuAAuAuuuGcucAcudTsdT | 1277 | AGUGAGcAAAUuAUuAAUGdTsdT | 1335 | humanRhesus |
| AD-47971.1 | GuAcGucuAucAAAGGuAdTsdT | 1278 | uACCUUUGAuAGAcAGuACdTsdT | 1336 | humanRhesus |
| AD-47963.1 | cuuGuGGAuGccAcuAAcudTsdT | 1279 | AGUuAGuGGcAUCcAcAAGdTsdT | 1337 | humanRhesus |
| AD-47965.1 | GuucAGuAcGucuAucAAdTsdT | 1280 | UUGAuAGAcAGuACUGAAdTsdT | 1338 | humanRhesus |
| AD-47992.1 | cuuGGAuuccAGAuuuAcAdTsdT | 1281 | UGuAAUCuAGGAAUCcAAGdTsdT | 1339 | humanRhesus |
| AD-47998.1 | GGucuGuAGcAAGcuGAGudTsdT | 1282 | ACUcAGCUUGCuAcAGACCdTsdT | 1340 | humanRhesus |
| AD-47958.1 | GAuuuuAAAGGAccucAuudTsdT | 1283 | AAUGAGGUCCUUuAAAAUCdTsdT | 1341 | humanRhesus |
| AD-47961.1 | cAAAcuuuucuuAucAGcAdTsdT | 1284 | UGCUGAuAAGAAAAGUUUGdTsdT | 1342 | humanRhesus |
| AD-47969.1 | GuGGAuGccAcuAAcucGAdTsdT | 1285 | UCGAGUuAGUGGcAUCcACdTsdT | 1343 | humanRhesus |
| AD-47978.1 | GucAGcGAcAccAcAAAGAdTsdT | 1286 | UCUUUGUGGUGUCGCUGACdTsdT | 1344 | humanRhesus |
| AD-47305.1 | ucAuGAGcuuuGuGAAccudTsdT | 1287 | AGGUUcAcAAAGCUcAUGAdTsdT | 1345 | humanRhesus Mouse |
| AD-47325.1 | GAGAcGGcccuuAcGAcAAdTsdT | 1288 | UUGUCGuAAGGGCCGUCUCdTsdT | 1346 | humanRhesus Mouse |
| AD-47329.1 | AcGGcccuuAcGAcAAGcAdTsdT | 1289 | UGCUUGUCGuAAGGGCCGUdTsdT | 1347 | humanRhesus Mouse |
| AD-47309.1 | AAccuGGuGGAGuAcGAcAdTsdT | 1290 | UGUCGuACUCcACcAGGUUdTsdT | 1348 | humanRhesus Mouse |
| AD-47317.1 | GcAGAGAcGGcccuuAcGAdTsdT | 1291 | UCGuAAGGGCCGUCUCUGCdTsdT | 1349 | humanRhesus Mouse |
| AD-47313.1 | AccuGGuGGAGuAcGAcAAdTsdT | 1292 | UUGUCGuACUCcACcAGGUdTsdT | 1350 | humanRhesus Mouse |
| AD-47321.1 | AGAGAcGGcccuuAcGAcAdTsdT | 1293 | UGUCGuAAGGGCCGUCUCUdTsdT | 1351 | humanRhesus Mouse |
| AD-47333.1 | ucccAcucAAcGcAcAcAudTsdT | 1294 | AUGUGUGCGUUGAGUGGGAdTsdT | 1352 | humanRhesus Mouse |
| AD-48038.1 | ucAAcGAcGcGGAcAuGGudTsdT | 1295 | ACcAUGUCCGCGUCGUUGAdTsdT | 1353 | mouseRat |

TABLE 21-continued

BMP6 Duplexes

| duplexName | sOligoSeq | SEQ ID NO | asOligoSeq | SEQ ID NO | Set |
|---|---|---|---|---|---|
| AD-48010.1 | GccAucucGGuucuuuAcudTsdT | 1296 | AGuAAAGAACCGAGAUGGCdTsdT | 1354 | mouseRat |
| AD-48042.1 | AAuGccAucucGGuucuuudTsdT | 1297 | AAAGAACCGAGAUGGcAUUdTsdT | 1355 | mouseRat |
| AD-48000.1 | AAcGAcGcGGAcAuGGucAdTsdT | 1298 | UGACcAUGUCCGCGUCGUUdTsdT | 1356 | mouseRat |
| AD-48004.1 | AuGccAucucGGuucuuuAdTsdT | 1299 | uAAAGAACCGAGAUGGcAUdTsdT | 1357 | mouseRat |

It should be noted that unmodified versions of each of the modified sequences shown are included within the scope of the invention.

SEQUENCE LISTING (1377 sequences)

SEQ ID NO: 1 - DNA, 430 bp, Homo sapiens
gactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaa

SEQ ID NO: 2 - DNA, 391 bp, Macaca fascicularis
tcaagacctagcagtgggacagccagacagacggcacgatggcactgagctcccagatctgggccacttgcctcctcctccttctcctcctcgccagcctgaccagtggctccgttttcccacaacagacgggacaacttgcagagctgcaacctcaggacagagctggagccagggccagctggacgcccatgctccagaggcgaaggaggcgagacacccacttccccatctgcattttctgctgcggctgctgtcatcgatcaaagtgtgggatgtgctgcaggacgtagaaccttcctgccctgcccccatcccctcccttccttatttattcctgctgccccagaacacaggtcttggaataaaacggctgattcttttgttttcc

SEQ ID NO: 3 - DNA, 410 bp, Mus musculus
agtccttagactgcacagcagaacagaaggcatgatggcactcagcactcggacccaggctgcctgtctcctgcttctcctccttgccagcctgagcagcaccacctatctccatcaacagatgagacagactacagagctgcagcctttgcacggggaagaaagcagggcagacattgcgataccaatgcagaagagaaggaagagagacaccaacttccccatctgcatcttctgctgtaaatgctgtaacaattcccagtgtggtatctgttgcaaaacatagcctagagccacatcctgacctctctacacccctgcagcccctcaaccccattatttattcctgccctccccaccaatgaccttgaaataaagacgattttattttcaaaaaaaaaaaaaaaaaa

SEQ ID NO: 4 - DNA, 367 bp, Rattus norvegicus
cacgagggcaggacagaaggcaagatggcactaagcactcggatccaggctgcctgtctcctgcttctcctcctggccagcctgagcagcggtgcctatctccggcaacagacgagacagactacggctctgcagccttggcatggggcagaaagcaagactgatgacagtgcgctgctgatgctgaagcgaaggaagcgagacaccaacttccccatatgcctcttctgctgtaaatgctgtaagaattcctcctgtggtctctgttgcataacatagagagccaagagccttgtcctgacctctcaacacactgcctcccctccgccccattatttattcctgtcctaccccagcaatgaccttg

SEQ ID NO: 5 - DNA, 1488 bp, Homo sapiens
accgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacactcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatcaaaaaaaaaaaaaaaaaaa

SEQ ID NO: 6 - DNA, 2148 bp, Macaca mulatta
cttctctggctccctgacctcagtgagacagcagccggcctggggacctgggggagacatggagaaagagacggaggaccccctggctggagctgacccacagagtagggaatcatggctggagaattggatagcagagtaatgtttgacctctggaaacaccaaatttcttttttcagtcacttacagggcttccggtcaaaattcactaggtaggagggtcatcagctgggaagaaccggcgcctggggaacctggctggataggtatgggggagcaaggccagtcccctagtcccaggtcctcccatggcagtcccccaactctaagcactctcactctcctgctgctcctctgtggacatgctcattctcaatgcaagatcctccgctgcaatgctgagtatgtatcgtccactctgagccttagaggtggcggttcatcaggagcacttcgaggaggaggaggaggaggaggccggggtggaggggtgggctctggcggcctctgtcgagccctccgctcctatgcgctctgcactcggcgcaccgcccgcacctgccgtggggacctcgccttccattcggcggtacatggcatcgaagacctgatgatccagcacaactgctcgcgccagggccctacagcccctcccccgccccggggccccgcccttccaggcgcaggctccggcctccctgccccggacccttgtgactatgaaggccggttttcccggctgcatggtcgtcccccggggttcttgcattgcgcttccttcggggacccccatgtgcgcagcttccaccaccattttcacacatgccgtgtccaaggagcttggcctctactggataacgacttcctctttgtccaagccaccagctcccccatggcgttgggggccaacgctaccgctacccggaagctcaccatcatatttaagaacatgcaggaatgcattgatcagaaggtctatcaggctgaggtggataatcttcctgcagcctttgaagatggttctgtcaatggaggtgaccgacctgggggatccagtttgtcgattcaaactgctaaccctgggaaccacgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcagtcgtccgggagctataaccattgatactgccagacggctgtgtaaggaagggcttccagtggaagatgcttacttccattcctgtgtctttgatgttttaatttctggtgatcccaactttactgtggcagctcaggcagcactggaggatgcccgagccttcctgccagacttagataagctgcatctcttcccttcagatgctggggtttctctttcctcagcaaccttcctagccccactcctttctgggctctttgttctgtggctttgcattcagtaaggaagccatcagtcctattactagtttggaaatgatttggggatagagattggcatagaagaatgtaaacaatcattaaaggaagcagggcccagaagacacatgaaacaatgacatcatccagagtcagatgaggctgcagtccagggttgaaatgatcacagaataaggattctgggcaaggtttctgcattccagacctcttcgccaaattttccagccccatttacagtaaacaaattgttctttccatttactgcagatttcaccctataagcttagaggtcatgaaggttttaacaatcagtaaagacttaagggttgagatttttaagaggcaagagctgaaagcagaagacatgatcattagccataagaaactcaaaggaagaagaaataattagggaaagaagtctatttgatgaatatgtgtgtgtaaggtatgttctgctttcttggttcaaaaatgaagcgggcgttgtctagctcttaggtgaagggagtctctgctttggaagaacggcacaggtaggacagaagtatcatccctacccctaactgatctgttattaaagctacaaattcttcacaccgtc

SEQ ID NO: 7 - DNA, 2021 bp, Mus musculus
ggctctctgacctgagtgagactgcagccattccggggcaatcatggagaaagagatgggggaccccctggctggagcagaccaacagaataggcaactatggctcgagaacccagtatcagagtaatgcttgacctcgggaaacatcacagaagtacccagagaaattcactaggtaggaggctcatcatctgggaagaaccggtgcctggggggacctggctggataggtatgggccagtcccctagtccccggtccccccacggcagccctccaactctaagcaccctcactctcctgctgctcctctgtggacaggctcactcccagtgcaagatcctccgctgcaatgccgagtatgtctcgtccactctgagtcttcggggaggtggctcaccggacacgccgcgtggaggcggccgtggtgggctggcctcaggtggcttgtgtcgcgccctgcgctcctacgctctctgcacgcggcgcacggcccgcacctgccgcggggaccttgctttccactctgcggtgcatggcatagaggacctgatgatccagcacaactgctcacgccagggtcccacggccccgcccccggcccggggccccgccctgcccggggccgggccagcgcccctgaccccagatccctgtgactatgaggcccggttttccaggctgcacggtcgagccccgggcttcttgcattgcgcatcctttggagatccccatgtgcgcagtttccacaaccaatttcacacatgccgtgtccaaggagcttggcccttgctagataacgacttcctctttgtccaggccaccagctccccggtttcgtcgggagccaacgctaccaccatccggaagatcactatcatatttaaaaacatgcaggaatgcattgaccagaaagtctaccaggctgaggtggacaatcttcctgcagcctttgaagatggttctatcaatgggggcgaccgacctgggggctcgagtttgtccattcaaactgctaaccttgggagtcacgtggagattcgagctgcctacattggaacaactatcatcattcgacagacagctgggcagctctccttctccatcagggtagcagaggatgtggcgcgggccttctccgcagagcaggacctacagctgtgtgttgggggatgccctccgagccagcgactctctcgctcagagcgcaaccgccgtggggctatagccatagatactgccagaaggctgtgtaaggaagggcttccggttgaagatgcctacttccaatcctgcgtctttgatgtttcagtctccggtgaccccaactttactgtggcagctcagacagctctggacgatgcccgaatcttcttgacggatttagagaacttacatctctttccctcagatgcggggcctcccctctctcctgccatctgcctagtcccgcttctttcggccctctttgttctgtggctttgcttcagtaagtaggccagcaacccatgactggtttggaaacgatttgaggatagaggttggtgtgagaaaccacaaagatgtgccaaaggaaacagcggggacaggagacaacacttactcaatcagatgaggttgcagtccagggctgaaatgaccctagaataaagattctgggccagggttttgcactccagaccttggtgtgggctattcaccatggatttcccagttagtgatttcccacttgtaatgaaattccactctccatacacctgataccactcctacaagcctagagattgtgagagtgctaatgaccagtgaaacattaaaggactgagatatcgtaaaggcaaaaacatgattctctttgagaaagtcaaaagaggagaagctaattaggaaaagcttttggttcagaaacgaagtgggcattgtctggcagaggaagtcagcttttggagactggcaccaactcagaaacgggcatttccatcccttcctaatctgttattaaagcgattagttctccatcctg

SEQ ID NO: 8 - DNA, 2150 bp, Rattus norvegicus
cggggacagacatggagaaggagatggaggaccccctggctggagcagaccaacagaataggcaactatggctggagaaccgggtatcagagtaatgcttgacctcgggaaacaccaaatttcttcttccgatcgcagaagtagtactcggcgaaattcactaggtaggaggctcctcatctgggaagaaccggtgcctggggggacctggctggataggtatgggggatcgaggccggtcccctagtctccggtccccccatggcagtcctccaactctaagcaccctcactctcctgctgctcctctgtggacaggctcactcccagtgcaagatcctccgctgcaatgccgagtacgtctcgtccactctgagccttcggggagggggctcaccggacacgccacatggaggcggccgtggtgggccggcctcaggtggcttgtgtcgcgccctgcgctcctacgctctctgcacgcggcgcaccgcccgcacctgccgcggggacctcgctttccactccgcggtgcatggcatagaggacctgatgatccagcacaactgctcacgccagggtcccacggcctcgcccccggcccggggtcctgccctgcccggggccggcccagcgcccctgaccccagatccctgtgactatgaagcccggttttccaggctgcacggtcgaaccccgggtttcttgcattgtgcttcctttggagacccccatgtgcgcagcttccacaatcactttcacacatgccgcgtccaaggagcttggcccctactagataacgacttcctctttgtccaagccaccagctccccggtagcatcgggagccaacgctaccaccatccggaagatcactatcatatttaaaaacatgcaggaatgcattgaccagaaagtctaccaggctgaggtagacaatcttcctgcagcctttgaagatggttctgtcaatgggggcgaccgacctgggggctcgagtttgtccattcaaactgctaaccttgggagccacgtggagattcgagctgcctacattggaacaactataatcgttcgtcagacagctggacagctctccttctccatcagggtagcggaggatgtggcacgggccttctctgctgagcaggatctacagctgtgtgttgggggatgccctccgagccagcgactctctcgctcagagcgcaatcgccgtggggcgatagccatagatactgccagaaggttgtgtaaggaagggcttccggttgaagatgcctacttccaatcctgcgtctttgatgtttcagtctccggtgaccccaactttactgtggcagctcagtcagctctggacgatgcccgagtcttcttgaccgatttggagaacttgcaccttttcccagtagatgcggggcctcccctctctccagccacctgcctagtccggcttctttcggtcctctttgttctgtggttttgcattcagtaagtaggccagcaacccgtgactagtttggaaacggtttgaggagagaggttgatgtgagaaaacacaaagatgtgccaaaggaaacagtggggacaggagacaacgaccttactcaatcacacgaggttgcagtccagggctgaaatgaccctagaataaagattctgagacagggttttgcactccagaccttggtatgggctccccatgaatttccccattagtgatttcccacttgtagtgaaattctactctctgtacacctgatatcactcctgcaaggctagagattgtgagagcgctaagggccagcaaaacattaaagggctgagatatcttaaaggcagaaactagaaaaggggaaaccatgattatctataagaaaatcaaaagaggggtttgggaatttagctcagtggtagagcacttgcctagcaagcgcaaggccctgggttcggtccccagctcctaaaaaagaaaaaaaaaatcaaaagagaaaaaactaattaaggcaagctttttggttcagaaatgaagtgggcattgtctggcagaggaagtcagcttttggagactggcaccaacatctccacccttcctactctgttattaaagtgacgaattccccaaaaaaaaaaaaaaaaaaaaaaaaaaaaaagg

SEQ ID NO: 9 - DNA, 2891 bp, Homo sapiens
cgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagccaaaa

SEQ ID NO: 10 - DNA, 2471 bp, Homo sapiens
ccctgcccctggcgaccccacgtctctggcatccttccctcttccctccctctcctccgggcgcccagaaaagtccccacctctccccgcttaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagaaggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagccaaaa

SEQ ID NO: 11 - DNA, 2694 bp, Macaca mulatta
accccaggacctgcgctcagggagcaggcaggtgtggggctgtggagagattggcaggggagagcacagccgcttgtgctctggcctggactcaggggccacgtctggaaggttggaccgaggccaggactgtgcccccacccttgggggtggtaaggagcagccttggctcaggctttctgccagggctgataaggagccctcctggggctcccacaaacggtttatcggtttatcactggggacagcctgcaggcttcaggagggggcacaagcatggagcagctttggggtctactccagagagcgcaacaactgtccccaagatcctctcagaccgtctaccagcgtgtggaaggcccccagaaagggcacctggaggaggaagaggaagacggggaggagacactggcccacttctgccccatggagctgaagggccctgagcccctgggctctagacccaggcagccaaacctcattccctgggcagcagcaggacggagggctgccccctacctggtcctgactgctctactgatcttcactggggccttccttctgggctacgtcgccttccgagggtcctgccagacatgcggagactccgtgttggtggtcagtgaggacgtcaactatgagcctgacctggatttccaccggggcacactgtactggagcgacctccaggccatgttcctgcagttcctgggggaggggcgcctggaggacaccatcaggcaaaccagccttcgggaacgggtggcaggctcggccgggatggccgctctgactcaggatatccgcgcggcgctctctcgccagaagctggaccacgtgtggaccgacacgcactacgtggggctgcaattcccggacccggctcaccccaacaccctgcactgggtcgatgaggccgggaaggtcggagagcagctgccgctagaggaccctgacgtctactgcccctacagcgccatcggcaacgtcacgggagagctggtgtacgcccactacgggcggcccgaagacctgcaggacctgcgggccaggggcgtggacccagcgggccgcctgctgctagtgcgcgtgggggtgatcagcttcgcccagaaggtgaccaatgctcaggactttggggctcaaggagtgctcatatacccagagccagcggacttctcccaggacccacacaagccaagcctgtccagccagcaggctgtgtatggacatgtgcacctgggaactggagacccctacacgcctggcttcccttccttcaatcaaacccagttccctccagttgcatcatcgggccttcccagcatcccagcccagcccatcactgcagacattgcctcccgcctgctgaggaagctcaaaggccctgtggccccccaggaatggcaggggagcctcctaggctccccttatcacctgggccccgggccacgactgcggctagcggtcaacaaccacaggacctccacccccatcaacaacatctttggctgcatcgaaggccgctcagagccagatcactatgttgtcatcggggcccagagggatgcgtggggcccaggagcagctaaatccgctgtggggacagctatactcctggagctggtgcggaccttttcctccatggtgagcaacggcttccggccccgcagaagtctcctcttcatcagctgggatggcggtgactttgggagcgtgggctccacagagtggctagagggctacctcagtgtgctgcacctcaaagctgtagtgtacgtgagcctggacaacgcagtgctgggggatgacaagtttcatgccaagaccagcccccttctgacaagtctcattgagagtgtcctgaaacaggcaagagcaccccaggaatggctgaccctgcagtgggtgtactccgcgcggggggactacatccgggcggcggagaagctgcggcaggagatctacagctcggaggagagagacgagcgactgacacgcatgtacaacgtgcgcataatgcgggtggagttctacttcctttcccagtacgtgtcgccggccgactccccgttccgccacatcttcatgggccgcggagaccacacgctgggcgccctgctggaccacctgcggctgctgcgctccaacagctccgggacccccggggccacctcctccgccgtcttccaggagagtcgcttccggcgtcagctagccctgctcacctggacgctgcaaggggcagccaatgcgcttagcggggacgtctggaacattgataacaacttctgagaccctggggatcctcagatccccctgtccccttgtcgagagctcctctgctcctcgcttcaatgattcagggtcagggaggtggctcagagtccacctctcattgctgatcgacttctcattacccctacacgtctctccacggagcccagactgcagcacagatatccacacaccccagccctgcagtgtagctgactctaatgtgatggtcatactgtcggttaatcagagagcagtatcccttcaatcacaaccccttcccctttctggggtcctccatacctagagactaggccttgggacctggccagctctcttagcgggagagatcgctggcaccatagccttatggccaacaggtggtctgtggtgaaaggggcatggagtttcaatgtc

SEQ ID NO: 12 - DNA, 2926 bp, Mus musculus
gagcatggtccaagaaacccagagacctgttgctgagctgaacttggctgctgtgtcttcccactcaggactcggctttgacagctgcaggtcctggtgtcttcgtcgcggcttggatttcaaactggaggagttcaggagggggcacaagcatggagcaacgttggggtctacttcggagagtgcaacagtggtccccaagaccctctcagaccatctacagacgcgtggaaggccctcagctggagcacctggaggaggaagacagggaggaaggggcggagcttcctgcccagttctgccccatggaactcaaaggccctgagcacttaggctcctgtcccgggaggtcaattcccataccctgggctgcagcaggtcgaaaggctgccccctatctggtcctgatcaccctgctaatcttcactggggccttcctcctaggctacgtggcctttcgagggtcctgccaggcgtgtggggactccgtgttggtggtcgatgaagatgtcaaccctgaggactccggccggaccacgttgtactggagcgacctccaggccatgtttctccggttccttggggaggggcgcatggaagacaccatcaggctgaccagcctccgggaacgcgtggctggctcagccagaatggccaccctggtccaagatatcctcgataagctctcgcgccagaagctggaccacgtgtggactgacacgcactacgtgggacttcagttcccagatccggctcacgctaacaccctgcactgggtggatgcagacgggagcgtccaggagcagctaccgctggaggatccggaagtctactgtccctacagcgccaccggcaacgccacgggcaagctggtgtacgcccactacgggcggtcggaggacctacaggacctaaaagccaagggcgtggagctggccggcagcctcctgctagtgcgagttggaattactagcttcgcccagaaggtagccgttgcccaggactttggggctcaaggagtgctgatataccctgacccatcagacttctcccaggatccccacaagccaggcctgtctagccaccaggctgtgtacggacatgtgcacctgggaactggagacccttacacacctggcttcccgtccttcaatcaaacccagttccctccagtagaatcatcaggccttcccagcatccccgcccagcccatcagtgctgacattgctgatcaattgctcaggaaactcacaggccccgtggctccccaggagtggaaaggtcacctctcaggctctccttatcggctgggacctgggcccgacttacgccttgtggtcaacaaccacagagtctctacccccatcagtaacatctttgcgtgcatcgagggctttgcagagccagatcactatgttgtcattggggcccagagggatgcatggggcccaggagcagccaagtctgcagtggggactgccatcctgctggagctggttcggaccttctcttccatggtcagcaatgggttcagacctcgaagaagtcttttgttcatcagctgggacggaggtgactttggcagcgtgggagccacagagtggttggagggctacctcagcgtgctacacctcaaagctgttgtgtacgtgagcctggacaactccgtgttgggagatggcaaattccatgctaagaccagcccccttctcgtcagcctcattgagaatatcttgaagcaggtggactcccctaaccatagtggacagaccctctatgaacaagtggcactcacccaccccagctgggatgctgaagtgattcagcccctgcccatggacagcagtgcatattccttcacagcctttgcgggggtcccagctgtggagttctccttcatggaggatgatcgggtgtacccattcctgcacacgaaggaggacacatatgagaatctgcacaagatgctgcgaggtcgcctgcccgccgtggtccaggcagtggctcagctcgcgggccagctcctcatccgactgagccacgatcacctactgccgctagacttcggccgctatggagacgtggttctcaggcacatcggcaacctcaatgagttctctggggacctcaaggagcgcgggctgaccctgcagtgggtgtactctgcaaggggggactacatccgtgcggcggaaaagctgcggaaggagatttacagctcggagcggaacgatgagcgtctgatgcgcatgtacaacgtgcgcatcatgagggtggagttctacttcctgtcccagtatgtgtcgccagccgactccccattccgccacattttcctaggccaaggcgaccacactttgggtgccctggtagaccacctgcggatgctgcgcgccgatggctcaggagccgcctcttcccggttgacagcaggtctgggcttccaggagagtcgcttccggcgccagctggcgctgctcacctggacactgcagggggcagccaacgctctcagtggcgacgtttggaacattgacaataacttttgaagccaaaagccctccatgggccccacgtgattctcctttctccctctttgagtggtgcaggcaaaggaggtgcctgagattgtaacctattcttaacacccttggtcctgcaatgctggtgcgccatattttctcagtgtggttgtcatgccgttgcttacccagaaagcggttttcttcccatcacaggcccttctgtcttcaggagcaaagttccccatatctagagactatctagatgctgggatctgatcagctctcttagagagtgagatggacagcgtcattattttatgacacatgagctacggtatgtgagcagcccaaggggattagatgtcaataaaccaattgtaacccctgttgtccatacgcaa

SEQ ID NO: 13 - DNA, 2964 bp, Rattus norvegicus
aaatccagagacctgttgctgagttgaacttggctgctgtgtcttcccactcaggactcggctttgacaggcacgaggcagggactggggtgagcccctacctctcagatctttctggacctggctgcgggtcctgggatcttcagcgcggcttggatttcaaactggaggggttcaggagggggcacaagcatggaacaacgttggggtctacttcggaaagtgcaacagtggtccccaagaccctctcagaccatctacagacgtgtggaaggccctcaactggagaacctagaggaggaagatagggaggaaggggaggagcttcctgcccagttctgccccatggaactcaaaggccctgagcgcttaggctcctgtcctgggaggtccattcccataccctgggctgcagcaggtcgaaaggctgctccctatctggtcctgaccaccctgctaatcttcactggggccttcctcctgggctacgtggcctttcgagggtcctgccaggcatgtggggactctgtgttggtggttggtgaagatgtcaactctgaggactccagccggggcacgttgtactggagtgacctccaggacatgtttctccggttccttggggagggacgcatggaggacaccatcaggctgaccagcctccgggaacgcgtggccggctcagccagaatggccaccctggtccaagacatcctcgataagctctcgcgccagaagctggaccacgtgtggactgacacgcactatgtgggacttcagttcccggacccggctcaccctaacaccctgcactgggtgggtgcagacgggagcgtccaagagcagctaccgctggaggatccggaagtctactgtccctacagcgccacgggcaacgccacgggcaagcttgtgtacgcccactacgggcggcgggaggacctgcaggacctgaaagccaaggacgtggagctggccggcagcctcctgctagtgcgtgctgggattacaagcttcgcccagaaggtagccattgcccaggactttggggcccacggagtgctgatataccctgacccagcggacttctcccaagacccccacaagccaggcctgtctagtgacagggctgtgtatggacatgtgcacctgggaactggggacccttacacgcctggcttcccgtccttcaatcaaacccagttccctccagtagaatcatcggggcttcccaacatccctgcccagcccatcagtgccgacgttgctgatcgcttgctcaggaaactcacaggtcccgtggctcctcaggaatggaagggtcgcctctcagactctccgtatcgcctgggacctgggccaggcttacgccttgtggtcaacaaccacagaacctctactcccatcagtaacatctttgcgtgcatcgagggcttcgcagagccagatcactatgtcgttatcggggcccagagggatgcctggggcccaggagcagccaagtctgcagtggggactgccatcctcctggagctggttcggaccttttcctccatggtcagcagtggctttagacctcgaagaagtcttttgttcatcagctgggacggaggtgactttggcagcgtgggagccacggagtggttggagggctacctcagcgtgctacacctcaaagctgtcgtgtatgtgagcctggacaactccgtgttgggagacggcaaattccatgctaagaccagcccccttctcgtcagcctcattgagaatatcctgaagcaggtggattcccctaaccacagtggacagacactctacgatcaagtggcattcacccacccaagctgggatgctgaagtgatccagcccctgcccatggacagcagcgcatattccttcacagcttttgcgggcgtcccagctgtggagttctccttcatggaggacgatagggtgtacccattcctgcacacgaaggaggacacgtatgagaatctgcacaagatgctgcgaggtcgcctgcccgccgtggtcctagcagtggctcagctcgctggtcagctcctcatccgactgagccacgatcacctactgccgctggacttcggccgctacggagacgtggtcctcaggcacatcggcaaccttaatgagttctctggggacctcaaggcgcgcgggctgaccctgcagtgggtgtactctgcaaggggggactatatccgggcggcggagaagctgcggaaggagatttacagctcggagcagagcgatgagcgtctgatgcgcatgtacaacgtgcgcatcatgagggtggagttctacttcctgtcccagtacgtgtcgccggccgactccccattccgccacattttcctaggccaaggcgaccacactttgggtgccctggtggaacacctacggatgctgcgctccgatggctcaggagctgcctcttctgggttgagcccaggtctgggcttccaggagagtcgcttccggcgacagctggcgctgctcacgtggacgctacagggggcagccaacgcactcagtggcgacgtttggaacatcgacaataacttttgaggccagaagtcctccatgggccccacgtgattctcctttctccctatttgagtggtgcaggcaacggaggtgcctgagagcaacctatcctcattaacaaccttggtcctgcaacgccagtgagacatattttctcagtgtgactgttataccactgtttatccagaaagcggttttcttcccatcactggcctctctgccttcaggagcatagttccccatatctagaaaccatctagacactgggatccagctctcttagcgggtgagatggatagcgtcattttcttatgacacacaagtggtatgtgggtggcccaagggggattagatgtcaataaaccatttacctggtaacctctgttgtccataagc

SEQ ID NO: 14 - DNA, 2180 bp, Homo sapiens
ctaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgcagaccgcggtcctgcaggggcgcttgctgcgttcacactctctgcactacctcttcatgggtgcctcagagcaggaccttggtctttccttgtttgaagctttgggctacgtggatgaccagctgttcgtgttctatgatcatgagagtcgccgtgtggagccccgaactccatgggtttccagtagaatttcaagccagatgtggctgcagctgagtcagagtctgaaagggtgggatcacatgttcactgttgacttctggactattatggaaaatcacaaccacagcaaggagtcccacaccctgcaggtcatcctgggctgtgaaatgcaagaagacaacagtaccgagggctactggaagtacgggtatgatgggcaggaccaccttgaattctgccctgacacactggattggagagcagcagaacccagggcctggcccaccaagctggagtgggaaaggcacaagattcgggccaggcagaacagggcctacctggagagggactgccctgcacagctgcagcagttgctggagctggggagaggtgttttggaccaacaagtgaccactctacggtgtcgggccttgaactactacccccagaacatcaccatgaagtggctgaaggataagcagccaatggatgccaaggagttcgaacctaaagacgtattgcccaatggggatgggacctaccagggctggataaccttggctgtaccccctggggaagagcagagatatacgtgccaggtggagcacccaggcctggatcagcccctcattgtgatctgggagccctcaccgtctggcaccctagtcattggagtcatcagtggaattgctgtttttgtcgtcatcttgttcattggaattttgttcataatattaaggaagaggcagggttcaagaggagccatggggcactacgtcttagctgaacgtgagtgacacgcagcctgcagactcactgtgggaaggagacaaaactagagactcaaagagggagtgcatttatgagctcttcatgtttcaggagagagttgaacctaaacatagaaattgcctgacgaactccttgattttagccttctctgttcatttcctcaaaaagatttccccatttaggtttctgagttcctgcatgccggtgatccctagctgtgacctctcccctggaactgtctctcatgaacctcaagctgcatctagaggcttccttcatttcctccgtcacctcagagacatacacctatgtcatttcatttcctatttttggaagaggactccttaaatttgggggacttacatgattcattttaacatctgagaaaagctttgaaccctgggacgtggctagtcataaccttaccagatttttacacatgtatctatgcattttctggacccgttcaacttttcctttgaatcctctctctgtgttacccagtaactcatctgtcaccaagccttggggattcttccatctgattgtgatgtgagttgcacagctatgaaggctgtacactgcacgaatggaagaggcacctgtcccagaaaaagcatcatggctatctgtgggtagtatgatgggtgtttttagcaggtaggaggcaaatatcttgaaaggggttgtgaagaggtgttttttctaattggcatgaaggtgtcatacagatttgcaaagtttaatggtgccttcatttgggatgctactctagtattccagacctgaagaatcacaataattttctacctggtctctccttgttctgataatgaaaattatgataaggatgataaaagcacttacttcgtgtccgactcttctgagcacctacttacatgcattactgcatgcacttcttacaataattctatgagataggtactattatccccatttcttttttaaatgaagaaagtgaagtaggccgggcacggtggctcacgcctgtaatcccag

SEQ ID NO: 15 - DNA, 1131 bp, Macaca mulatta
ttttactgggcatctcctgagcctaggcaatagctgtagggtgacttctggagccatcgccgtttccccgccccaccaaagaagcggagacttaaaggggacgtgcagtcagagctggggaaatgggcccgcgagccaggccggcgcttctcctcctgatgcttttgcagaccgcggtcctgcaggggcgcttgctgcgttcacactctctgcactacctcttcatgggttcctcagagcaggaccttggtctttccctgtttgaagctttgggctatgtggacgaccagctgttcgtgttctatgatcatgagagtcgccgtgtggagccccgaactccatgggtttccggtagaacgtcaagccagatgtggctgcagctgagtcagagtctgaaagggtgggatcacatgttcactgttgacttctggactattatggaaaatcacaaccacagcaaggagtcccacaccctgcaggtcatcctgggctgcaaaatgcaagaggacaacagtaccgagggcttctggaagtacgggtacgatgggcaggaccaccttgaattctgccctgacacactggattggagagcagcagaacccagggcctggcccaccaagctggagtgggaaaggcacaaaattcgggccaggcagaacagggcctacctcgagagggactgccctgtgcagctgcagcagttgctggagctggggagaggtgttttcgaccggccagtgaccactctacggtgtcgggccctgaactactacccccagaacatcaccatgaagtggctgaaggataggcagtcaatggatgccaaggaggtcgaacctaaagacgtattgcccaatggggatgggacctaccagggctggataaccttgactgtacccccaggggaagaacagagatatacttgccaggtggagcacccaggcctggatcagcccctccttgctttctgggagccctcaccatctagaactctagtcattggagtcatcagtggaattgctgtttttgtcatcatcttgttcattggaattttgttcataatattaaggaagaggcagacttcaagaggagtcatggggcactacgtcttagctgaacgtgagtgacacg

SEQ ID NO: 16 - DNA, 1722 bp, Mus musculus
ctgagaggtctggaacctcagcaatggctacagggtgacttcttggatcctccacgtttccagatcctagtgaagaccggtggacccagctgaggacatgagcctatcagctgggctccctgtgcggccgctgctgctgctgctgctactgctgtggtccgtggccccgcaggcactgccaccgcgttcacattctctaagatacctcttcatgggtgcctcagagccagacctcgggctgcctttgtttgaggctaggggctatgtggatgaccagctctttgtgtcctacaatcatgagagtcgccgtgctgagcccagggccccgtggatcttggagcaaacctcaagccagctgtggctgcatctgagtcagagcctgaaagggtgggactacatgttcatagtagacttctggaccatcatgggcaactataaccacagtaaggtcacgaagttgggagtggtgtccgagtcccacatcctgcaggtggtcctaggctgtgaggtgcatgaagacaacagtaccagcggcttctggagatatggttatgacgggcaagatcacctggaattctgccccaagacactaaactggagcgcagccgagccaggggcctgggccaccaaggtggaatgggacgagcacaagatccgtgccaaacagaacagggactacctggagaaggactgccccgagcagctgaaacggctcctggagctggggagaggcgttctgggacagcaagtgcctactttggtgaaagtgactcgccactgggcctctacggggacctctctaaggtgtcaggctctggacttcttcccccagaacatcactatgaggtggttgaaggacaaccaaccactggatgccaaagatgtcaaccccgagaaggtgctacctaacggggatgagacctatcaaggctggctgacattggccgtggcccctggggacgagacaaggttcacctgtcaagtggagcacccaggcctggaccagcctctcactgcctcttgggagcccttgcaatctcaggccatgattatcggaatcatcagtggagtcaccgtctgtgccatcttcttggttggaattctgttcctaatcttaaggaaaaggaaggcttcaggaggaaccatgggtggctatgtcttaacagactgtgagtgatctgcagcctgctgaaccacggaagagagaaaactcagccaaagacttggagggggcacacttgctccactgtaggacacagttggacctaacacacagaaactgcctgagaactgtgctcttagctttctctgttcactttcttaaggtgttttctccagttaagttcagttcctgaatagtagtgattgcaccagttgcaacctctccctccagaactggtctcatgattcttaggctgcttcttggaagcatcctatgtttccttcatgcacctagactccatatgtctacgtaaagagcccctctaagtttagtggatacatgattcgtttccacatctgaagaagttgtgaaccttcatccggggatgctcacacatacttgagccagaatttttcacctatatcctagaatccaggacccactcaactatcctccatctgttatagagtgactcctctgtcaccatgccctgacttctctgccattggagtgttatatatatggatcatcaataaagccatgaaggctacacaactgtg

SEQ ID NO: 17 - DNA, 1106 bp, Rattus norvegicus
tcagcaatggctacagggtgacttcttggatcctccacgtttccaggtcctagtgaaaaccggtggacccagctggaggcatggaccgatcagctgggctccctgtgcggctgctattgctgctgctgttgttgctgctgtggtccgtggccccgcaggcgctgcggcccgtgcctactttggtgaaagtgactcgccactgggcctctacagggacctctctaaggtgtcaggctctgaatttcttcccccagaacatcactatgaggtggttgaaggacagccagcccctagatgccaaggatgtcaaccctgagaacgtgctgccaaatggggatgggacctatcagggctggctgaccttggctgtggcccctggagaagagacaaggttcagctgtcaagtggagcacccaggcctggatcagcctctcactgccacttgggagccctcacggtctcaggacatgattattggaatcataagtgggatcaccatttgtgccatcttctttgttggaattctgatcctagtcttaaggaaaaggaaggtttcaggaggaaccatgggtgactatgtcttaacagagtgtgagtgacctgcagcatgcagaagcacagaagagagaagactcagccaaagacttggaggggacacacttgctccattctagaacacagctggacctaacacacagaaactgcctgaggactctgcccttagctttcctgtttgctttcttaaggtgttttctccagttaagttcagttcctgaataatagtgactgccccagctgcaacctctcccttcagaaccagtctcatgatctttaagctgctacttgcaggcatccttcgttttctgcatccacctagacttcgtatgtctacttaaaaagccccactaaatttgggggacacatgattcatttccacatctgaagaagttatgaaccttcatcctgggatgcacacattcttgtgccagaatttttcatacatatcctaggacccattcaattgtcatttgagcctctctatctgttagtgactactctgacttctctgccattggagtgttatggcaataaagctatgaacgtta

SEQ ID NO: 18 - DNA, 5481 bp, Mus musculus
ccgcgcgagacgacgactgtacggccgcgcgaggggcgaccgggcccgggccgctgcacgccgagggcggaggccgagccgggccccgccgccccgcggctgtccgtgcccgcccgcgccgagcgccggaggatgagtttctcgggatcccgatttatgaaaatatgcatcgctttgatactgtcttggaattcatgagatggaagcataggtcaaagctgttcggagaaattggaactacagttttatctagccacatctctgagaattctgaagaaagcagcaggtgaaagtcattgccaagtgattttgttctgtaaggaagcctccctcattcacttacaccagtgagacagcaggaccagtcattcaaagggccgtgtacaggacgcgtgcgaatcagacaatgactcagctatacacttacatcagattactgggagcctgtctgttcatcatttctcatgttcaagggcagaatctagatagtatgctccatggcactggtatgaaatcagacttggaccagaagaagccagaaaatggagtgactttagcaccagaggataccttgcctttcttaaagtgctattgctcaggacactgcccagatgatgctattaataacacatgcataactaatggccattgctttgccattatagaagaagatgatcagggagaaaccacattaacttctgggtgtatgaagtatgaaggctctgattttcaatgcaaggattcaccgaaagcccagctacgcaggacaatagaatgttgtcggaccaatttgtgcaaccagtatttgcagcctacactgccccctgttgttataggtccgttctttgatggcagcatccgatggctggttgtgctcatttccatggctgtctgtatagttgctatgatcatcttctccagctgcttttgctataagcattattgtaagagtatctcaagcaggggtcgttacaaccgtgatttggaacaggatgaagcatttattccagtaggagaatcattgaaagacctgattgaccagtcccaaagctctgggagtggatctggattgcctttattggttcagcgaactattgccaaacagattcagatggttcggcaggttggtaaaggccgctatggagaagtatggatgggtaaatggcgtggtgaaaaagtggctgtcaaagtgttttttaccactgaagaagctagctggtttagagaaacagaaatctaccagacggtgttaatgcgtcatgaaaatatacttggttttatagctgcagacattaaaggcactggttcctggactcagctgtatttgattactgattaccatgaaaatggatctctctatgacttcctgaaatgtgccacactagacaccagagccctactcaagttagcttattctgctgcttgtggtctgtgccacctccacacagaaatttatggtacccaagggaagcctgcaattgctcatcgagacctgaagagcaaaaacatccttattaagaaaaatggaagttgctgtattgctgacctgggcctagctgttaaattcaacagtgatacaaatgaagttgacatacccttgaataccagggtgggcaccaagcggtacatggctccagaagtgctggatgaaagcctgaataaaaaccatttccagccctacatcatggctgacatctatagctttggtttgatcatttgggaaatggctcgtcgttgtattacaggaggaatcgtggaggaatatcaattaccatattacaacatggtgcccagtgacccatcctatgaggacatgcgtgaggttgtgtgtgtgaaacgcttgcggccaatcgtgtctaaccgctggaacagcgatgaatgtcttcgagcagttttgaagctaatgtcagaatgttgggcccataatccagcctccagactcacagctttgagaatcaagaagacacttgcaaaaatggttgaatcccaggatgtaaagatttgacaattaaacaattttgagggagaatttagactgcaagaacttcttcacccaaggaatgggtgggattagcatggaataggatgttgacttggtttccagactccttcctctacatcttcacaggctgctaacagtaaaccttaccgtactctacagaatacaagattggaacttggaacttcaaacatgtcattctttatatatggacagctttgttttaaatgtggggtttttttgttttgctttttttgttttgttttggttttgatgcttttttggtttttatgaactgcatcaagactccaatcctgataagaagtctctggtcaacctctgggtactcactatcctgtccataaagtggtgctttctgtgaaagccttaagaaaattaatgagctcagcagagatggaaaaaggcatatttgccttctaccagagaaaacatctgtctgtgttctgtctttgtaaacagcctatagattatgatctctttgggatactgcctggtttatgatggtgcaccatacctttgatatgcataccagaattctctgctgccctagggcttagaagacaagaatgtaaaggttgcacaggaaggtatttgtggccagtggtttaaatatgcaatatctagttgacaatcgccaatttcataaaagccatccaccttgtaactgtagtaacttctccactgactttatttttagcataatagttgtgaaggccaaactccatgtaaagtgtccatagacttggactgttttcccccagtcaccattttgttctccttttggtaattatttttgttataaaaagccacctatccagaattggagctctctgtcttgaaccatactttgaaagaaacgcctcttccgtactgcatctgatcacaatgtgcatacctatgatcaaattctggagtctttgttctcggtacctcctaaaaaggaaagttgattcttgtgtaacatgcttttattttcagaacctgcacagctgtcattctagccatgttttacctacacactcagttctatacaagacagcccatacactctgtctcacatctgatccttggtgggaagtgttttaaagtagaactatgtatgaatttcagaattcatgcattttaaaacttcactaagatattgtctcatatctttatgagaatgtcagctgacttttcaactaacagtaaatgtattttagatatctaaatcttttgaaatttggttttacaatttctggtccctaattgtgaagacaagaggcagaagtacccagtcactacccatatttacactgaacgttattaaataaaatgatgtgtattttattataaaataaatataggccttgttatctcaaaaaacagatctggttcaaacttattataccaatatcatactatttaaatgttctaagtaaacaagccatgtgagcatcaagtggcattggctctttggatgaaacataaacttaaggtgattgtatcaacacatagagtgactgaaattaaatgggaggcaggtagagcatatgtccatctgtccacctacaggcatgactaaactacagctcatattccacaaatttgagatttgtcttgcctggtttgtttagtgagtctcatctgatgtacctaaagcctgagagtactgaggtctgattttatatctttcctgaataaactaaatcttttttgtcacttatcatcttaatgatatacctaaggaataattctttggcatgtttcagttgtgtgtggcagccactgtaatgactcttctctaagaaaggctgtcaggagttaattataaggcaggcagtgagcgctctagtcactgccttcccacgctgccatcactgcattcatgggaatcagtgacgttctcgaaatggcaaacgctgctgcttttccttatttggaatcctaaaatcaaaagttgcattaaacttactgtgttctcttctccctctcagccataaatgtaaaattcagtaagtaaaaatatttaaagagtgtatcagccctttggccagtgagatagctcagtagataaaggcatttgctgccaagtcctcaacctcaattcagactctgggggacacatggcgaagggaggagccaactaccccatcattgtcctctgacttccacacactccatggcttgcgcccctccccacagacacacaccatgtactccacaaaagtagtttaaaggaaaaaaagaatagaacccactgtgtaatggaataagtattatgtagttacttaacaacttgtaaaaatctggaaactatgatttggttcccctttgaatctagagtttaaaaaacagatggctaaaatcagccatcatttaaataattaaaaataaaagccccaaaccccaaactgcctaaataaataccaagtaatccaggaagccgtcatgtgtggtttgtatgaccagtagttctctggtacagagcatgttaagatttgccccagcctgattctctgaggtctctgcattactgagtactgttctgagtataaaatctgaactgatttctctagaaatactgtaacaaaaaggtattttagtcagcatgttatgttaacccttccactgtctagaaacttgaataagcacataaagacaccttttgctgtcatcatctgttgtcctggaatgtgccagttttaatttattcattctaatgatattcaatttgcttttcttttttagatgtttttcttgtttagagtaaaaggacgaatttttcaagaaccttgcatctctgatttggcctaaggtcaaattggatattgagtagtctattccagggcagatttcctaagcaatacttgtcttttcagctatgtattgttttgaaatgtttccatttcaacagaggtgtaagtcatgtgaaaagaaaggtggtgtagcccttgtggtaatgacacaagttgacttgcgtcagatgttaagcagggacagttctcccacctcctggctgtaaggagtggaaactaggcaagcagtgtatcagtccacagaggacaggaagggtcatcccataaagaaagcctgtgagtatggctttggcaaaaaattagacataatactgtccttttaggttgtgctctgttctttcctttcagtggaattatttaagctctttagtggcctttgtttttcccacttaaaaactaaaatgtagcatatattgtataaaatggaaatattaatagcttagggaaactgtacataaggcattgacaggtttaaaaaaagcatttttattatgcagttgtaaaacaccaaaaatatagattcatcttgatatgtaacactaagtgtattttgtacagcatctgatttgaaaggtgccttatgaagtttaccattaattgctttgttctatatacagattatgtccaatgtatcatttttcagtaaataaccttattttagta

SEQ ID NO: 19 - DNA, 3167 bp, Rattus norvegicus
gaattcatgagatggaaacataggtcaaagctgtttggagaaattggaactacagttttatctagccacatctctgagaagtctgaagaaagcagcaggtgaaagtcattgtcaagtgattttgttcttctgtaaggaaacctcgttcagtaaggccgtttacttcagtgaaacagcaggaccagtaatcaaggtggcccggacaggacacgtgcgaattggacaatgactcagctatacacttacatcagattactgggagcctgtctgttcatcatttctcatgttcaagggcagaatctagatagtatgctccatggtactggtatgaaatcagacgtggaccagaagaagccggaaaatggagtgacgttagcaccagaggacaccttacctttcttaaaatgctattgctcaggacactgcccagatgacgctattaataacacatgcataactaatggccattgctttgccattatagaagaagatgatcagggagaaaccacgttaacttctgggtgtatgaagtatgaaggctctgattttcaatgcaaggattcaccaaaagcccagctacgcaggacaatagaatgttgtcggaccaatttgtgcaaccaatatttgcagcctacactgccccctgtcgttataggcccattctttgatggcagcgtccgatggctggctgtgctcatctctatggctgtctgtattgtcgccatgatcgtcttctccagctgcttctgttacaaacattactgtaagagtatctcaagcagaggtcgttacaaccgtgacttggaacaggatgaagcatttattccagtaggagaatcactgaaagacctgattgaccagtcacaaagctctggtagtggatctggattacctttattggttcagcgaactattgccaaacagattcagatggttcggcaggttggtaaaggccggtatggagaagtatggatgggtaaatggcgtggtgaaaaagtggctgtcaaagtattttttaccactgaagaagctagctggtttagagaaacagaaatctaccagacggtgttaatgcgtcatgaaaatatacttggttttatagctgcagacattaaaggcaccggttcctggactcagctgtatttgattactgattaccatgagaatgggtctctctatgacttcctgaaatgtgccaccctggacaccagagccctactcaagttagcttattctgctgcctgtggtctgtgccacctccacacagaaatttatggcacgcaaggcaagcctgcaattgctcatcgagacctgaagagcaaaaacatccttattaagaaaaatggtagttgctgtattgctgacctgggcctagctgttaaattcaacagtgacacaaatgaagttgacatacccttgaacaccagggtgggcaccaggcggtacatggctccagaagtgctggacgagagcctgagtaaaaaccatttccagccctacatcatggctgacatctacagctttggtttgatcatttgggagatggcccgtcgctgtattacaggaggaatcgtggaggaatatcaattaccatattacaacatggtgcctagtgacccatcttatgaagacatgcgtgaggtcgtgtgtgtgaaacgcttgcggccaatcgtctctaaccgctggaacagtgatgaatgtcttcgagccgttttgaagctgatgtcagaatgctgggcccataatccagcatccagactcacagctttgagaatcaagaagacgctcgcaaagatggttgaatcccaggatgtaaagatttgacaaacagttttgagaaagaatttagactgcaagaaattcacccgaggaagggtggagttagcatggactaggatgtcggcttggtttccagactctctcctctacatcttcacaggctgctaacagtaaactttcaggactctgcagaatgcagggttggagcttcagacataggacttcagacatgctgttctttgcgtatggacagctttgttttaaatgtgggcttttgatgcctttttggtttttatgaattgcatcaagactccaatcctgataagaagtctctggtcaaactctggttactcactatcctgtccataaagtggtgctttctgtgaaagccttaaggaaattagtgagctcagcagagatggagaaaggcatatttgccctctacagagaaaatatctgtctgtgttctgtctctgtaaacagcctggactatgatctctttgggatgctgcctggttgatgatggtgcatcatgcctctgatatgcataccagacttcctctgctgccatgggcttacaagacaagaatgtgaaggttgcacaggacggtatttgtggccagtggtttaaatatgcaatatctaatcgacattcgccaatctcataaaagccatctaccttgtaactgaagtaacttctctaccaactttatttttagcataatagttgtaaaggccaaactatgtataaagtgtccatagactcgaactgttttcctccagtcaccattttgttttccttttggtaattatttttgttatataattcctcctatccagaattggcgctcactgtcttgaaccatactttgaaagaaatgcctcttcctggagtctgccttactgcatctgatcaccatgtgcatacctctgatcaaattctggagtctttgttctcggtacctcttaaaaagggaaattgtgtatcatgtgtagtgtgcttttattttcaaaatcttcatagcctttattctagccatttttacctacatactcattctgtacaaaacagctcactcggtctcacggctgatcctcagtggaaatgatttaaagtagagctgtgtacgaatttcagaattcatgtatttaaaaacttcacactaacactttactaagatattgtctcatatcttttatgaggatgtcagctgattttcaatgactataaatgtatcttagctatctaaatcttttgaaatttggttttataatttctggtccctaacttgtgaagacaaagaggcagaagtacccagtctaccacatttacactgtacattattaaataaaaaaatgtatattttaaaaaaaaaaaaaaaaaaaaa

SEQ ID NO: 20 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 21 - DNA, 3361 bp, Mus musculus
ccgctgcggtaacggagcggctcgggtggcggagcccgtgttcgcgtccgtccgcccgcccgcccgccgtcctccggaggcccttcccgcgccgcgctccgctccgcggccgtccccggggcgggagcgcgtgaccggagccggcgcccgcgagcgaggccccccgcagcggggcggctccggagctccagcggcccggccggccggcgcggtccgcggcgcggcggggagagggggccgcctgggccggacgccgcgggcggggcccgggaagcgacagcgaggcgaggcgcggtgcggcgcggagcccaggtcatcctgctcaccagatgtcttgacagtttttcttgcaacattggccattggttttcactgccttcaaaagatcaaaattactccagaaattggagagttggatttaaaagaaaaaacttgaacaaatggacaatatgtctataacaaatacaccaacaagtaacgatgcctgtctgagcattgtacatagtttgatgtgtcatagacaaggtggggaaagtgaaacctttgcaaaaagagcaattgagagtttggtaaagaagctgaaagagaaaaaagatgaattggattctttaataacagctataactacaaatggagctcatcctagcaagtgtgtcaccatacagagaacattggatggacgacttcaggtggctggtcggaaaggatttcctcatgtgatctatgcccgtctgtggaggtggcctgatctacacaagaatgaactaaagcatgttaaatattgtcagtatgcgtttgacttaaaatgtgacagtgtctgtgtgaatccatatcactatgagcgggttgtctcacctggaattgatctctcaggattaacactgcagagtaatgctccaagtatgttagtgaaggatgagtacgttcacgactttgaaggacagccgtccttacccactgaaggacattcgattcaaaccatccaacacccgccaagtaatcgcgcatcaacggagacgtacagcgccccggctctgttagccccggcagagtctaacgccaccagcaccaccaacttccccaacattcctgtggcttccacaagtcagccggccagtattctggcgggcagccatagtgaaggactgttgcagatagcttcagggcctcagccaggacagcagcagaatggatttactgctcagccagctacttaccatcataacagcactaccacctggactggaagtaggactgcaccatacacacctaatttgcctcaccaccaaaacggccatcttcagcaccacccgcctatgccgccccatcctggacattactggccagttcacaatgagcttgcattccagcctcccatttccaatcatcctgctcctgagtactggtgctccattgcttactttgaaatggacgttcaggtaggagagacgtttaaggtcccttcaagctgccctgttgtgactgtggatggctatgtggatccttcgggaggagatcgcttttgcttgggtcaactctccaatgtccacaggacagaagcgattgagagagcgaggttgcacataggcaaaggagtgcagttggaatgtaaaggtgaaggtgacgtttgggtcaggtgccttagtgaccacgcggtctttgtacagagttactacctggacagagaagctggccgagcacctggcgacgctgttcataagatctacccaagcgcgtatataaaggtctttgatctgcggcagtgtcaccggcagatgcagcaacaggcggccactgcgcaagctgcagctgctgctcaggcggcggccgtggcagggaacatccctggccctgggtccgtgggtggaatagctccagccatcagtctgtctgctgctgctggcatcggtgtggatgacctccggcgattgtgcattctcaggatgagctttgtgaagggctggggcccagactaccccaggcagagcatcaaggaaaccccgtgctggattgagattcaccttcaccgagctctgcagctcttggatgaagtcctgcacaccatgcccattgcggacccacagcctttagactgagatctcacaccacggacgccctaaccatttccaggatggtggactatgaaatatactcgtgtttataatctgaagatctattgcattttgttctgctctgtcttttcctaaagggttgagagatgtgtttgctgccttgctcttagcagacagaaactgaattaaaacttcttttctattttagaactttcaggtgtggctcagtgcttgaagatcagaaagatgcagttcttgctgagtcttccctgctggttctgtatggaggagtcggccagtgctgggcgctcagccctttagtgtgtgcgagcgccttgcatgccgaggagagtcagagctgctgattgtaaggctgagaagttctcacagttaagccacctgccccttagtgggcgagttattaaacgcactgtgctcacgtggcgctgggccagccagctctaccaagagcaactttactctcctttaaaaaccttttagcaacctttgattcacaatggtttttgcaagttaaacagtgaaggtgaattaaattcatactgtcttgcagacttcagggtttcttccccaagacaaaacactaatctgtgtgcatattgacaattccttacaattatcagtcaaagaaatgccatttaaaattacaatttttttaatccctaatggatgaccactatcaagatgtatactttgccctgttaaacagtaaatgaattcttctatatttctaggcacaaggttagttatttaaaaaaaaaaaaaaaagcctaggggagggatttttcccttaattcctagggagaaggttttgtataaaacactaaaagcagtgtcactctgcctgctgcttcactgttctgcaaggtggcagtacttcaactgaaataatgaatattttggaaactgctaaattctatgttaaatactgtgcagaataatggaaacagtgcagttggtaacaggtggtttggatatttttgtacttgatttgatgtgtgacttcttttcatatactgttaaaatcatgtatgttttgacattgtttaaaattcagtttttgtatcttagggcaagactgcagacttttttataccttttggttataagccctgtgtttgccatccttgatcacttggcggtgactttgtagagattgaagtggaggagttaagacacattgactgtaccacagacacacatgtatactttctacctagttactagcgtaaataaaactgagtcactataaaaaaaaaaaaaaaaaaaaa

SEQ ID NO: 22 - DNA, 3343 bp, Mus musculus
gcagtgcgagctgagtgtggagcccgaggccgagggcgactgctctcgctgccccagtctgccggccgcccggccccggctgcggagccgctctgccgcccgccgtcccgcgtagaaggaagcatgctgaccgtcggctgcacgctgttggtcgccctgctggccgcgcccgcggtcgcgctggtcctcgggagctgccgcgcgctggaggtggcaaatggcacagtgacaagcctgccaggggccaccgttaccctgatttgccccgggaaggaagcagcaggcaatgttaccattcactgggtgtactctggctcacaaaacagagaatggactaccacaggaaacacactggttctgagggacgtgcagctcagcgacactggggactatttatgctccctgaatgatcacctggtggggactgtgcccttgctggtggatgttcccccagaggagcccaagctctcctgcttccggaagaacccccttgtcaacgccatctgtgagtggcgtccgagcagcaccccctctccaaccacgaaggctgtgctgtttgcaaagaaaatcaacaccaccaacgggaagagtgacttccaggtgccctgtcagtattctcagcagctgaaaagcttctcctgccaggtggagatcctggagggtgacaaagtataccacatagtgtcactgtgcgttgcaaacagtgtgggaagcaagtccagccacaacgaagcgtttcacagcttaaaaatggtgcagccggatccacctgccaaccttgtggtatcagccatacctggaaggccgcgctggctcaaagtcagctggcagcaccctgagacctgggacccgagttactacttgctgcagttccagcttcgataccgacctgtatggtcaaaggagttcacggtgttgctgctcccggtggcccagtaccaatgcgtcatccatgatgccttgcgaggagtgaagcacgtggtccaggtccgtgggaaggaggagcttgaccttggccagtggagcgaatggtccccagaggtcacgggcactccttggatagcagagcccaggaccaccccggcaggaatcctctggaaccccacacaggtctctgttgaagactctgccaaccacgaggatcagtacgaaagttctacagaagcaacgagtgtcctcgccccagtgcaagaatcctcgtccatgtccctgcccacattcctggtagctggaggaagcttggcgtttgggttgcttctctgtgtcttcatcatcctgagactcaagcagaaatggaagtcagaggctgagaaggaaagcaagacgacctctcctccacccccaccgtattccttgggcccactgaagccgaccttccttctggttcctctcctcaccccacacagctctgggtctgacaataccgtaaaccacagctgcctgggtgtcagggacgcacagagcccttatgacaacagcaacagagactacttattccccagataatcatctggatggtacctggcagctggcagggcaccacgagatcagcacacaagtttctcatgcgggtcccatccacctggggtggggtggggcgggcggggctgcagcttcactaacccacaagagctctgcacaggttctgagtaggtgcagctggtgctgcataggctctgaaggaaggaaggggctgtgaggaacacaggccattgtgaagacagcttgtgatgactgaatagagatgcccgtcagctccacatctgatagtggctcacaagctgcaccctcaggaggcctcagaaaggggctccaaaggctgccccagctgcctcgctctgcctcactgccccaagccaccttttagctctcgaactcctaaagtccaagcactttgccattctctttccgaggccactgaggccgggtggaagcttggttccgatttccttctcaacatctggaaagcagctgggcccggtggtggtgactaatatctcagggcctgatggtttacgcgagtgacaatttctcacaagcagtttttaaatgtgaatgatgaccccaggcactgctggctgcggaggcttcattttcctcttcgatctcaggacttcaggcgaaaagcggagtggaagtagagagcggatgggtgtccaccgtcctcatggtacttgcgggaggtacagcctggaaaacacgtttcctgtccccctactctcccaggagagggatgatggtagggggtgcctcttccagggcggagagaactactttaccccagccttgcccattctgatttcaactggactggagctactaggaaagtcgacattcatgcaaaaagaaaaaacgttaactagcaagaatgcactttcattttggtttttagagaactgttgcctgtttctctcaagagtctggaagaggccgctcactgcacactactgtatgaaccctcactgcccaccctggaggaccaagtgcagtaacggtagcccaaacaccaagtcaagtgaaaatcgagggaaaaaaaaaacaaacaagcaacaaaaaaaaaaaaccaaaactaaactaaaaaacaaatcacccccccaaaaaaaaacaaaaccaaaaaccaaaaaaaacaaaaaaacaaaacaacaacaacaaaaaaaacccaaaccaacccgctgtttcctataacagaaaagcctttggtttcattttttattttgatttttttgtcttaaaaagtataaaaatagcctgtccatgctctgcttcagggaatgagcctgtgaacactcccaggcgcaggcaggaagggtgtctgcttcctgctacacctcactgccaccttggccttccttgctttacgtttgactgagtggcctcagatgctttcccctggggctttgaggaatccagtgatgttagtggtcaccgaggagaccacagagccacagtgtggtgcttagattaaagtgacttctgcaaccacagcaccccacacctgccgtcttactgaactatgccagtaacttgccttttctgccaccaccacgagacgagacgggcagagctcggaagctgtcaccccatgccctctgcttgtccgctctaggggccactgacctaagcattagttattttattttattttatttttttgtgggttttgtacattttaggtcctgttgctgtcttagaaaaggctctgtaggttgacagaaaatcaggccaagtattcatgttttgttttttttttttttccttctttcctcctttgctaagtttttgggactcaagggtagcaaaactgctgtgaaagggaaatttattaaaaatgttacagatcgtg

SEQ ID NO: 23 - DNA, 4529 bp, Rattus norvegicus
gccccacgtagaaggaaccatgctggccgtcggctgcaccctgctggtcgccctgctggccgcgcccgcagtcgcgctggtccttgggagctgccgcgcgctggaggtggcaaatggtacggtgacgagcctgccaggggccactgttaccctgatctgccctgggaaggaagcagcaggcaatgctaccattcactgggtgtactcaggctcacagagcagagaatggactaccacgggaaacacactggttctgagggccgtgcaggtcaacgacactgggcactatttgtgcttcctggatgatcatctggttgggactgtgcccttgctggtggatgttcccccagaggagcccaagctctcctgcttccggaagaacccccttgtaaatgccttttgtgagtggcatccaagcagcactccctctccaaccacgaaggctgtgatgtttgcaaagaaaatcaacaccaccaatgggaagagtgacttccaggtgccttgccagtattctcagcagctgaaaagcttctcctgcgaggtggagatcctggagggtgacaaagtgtaccacatagtgtcactgtgcgttgcaaacagtgtcggaagcaggtccagccacaatgtagtatttcagagtttaaaaatggtgcagccggatccacctgccaaccttgtggtatcagccatacctggaaggcctcgttggctcaaagtcagttggcaagaccctgagtcctgggacccaagttactacttgttgcaattcgagcttcgataccgacctgtatggtcaaagacgttcacggtgtggccgctccaggtggcccagcatcaatgtgtcatccatgatgccttgcgaggagtaaagcatgtggtgcaggtccgagggaaggaggagtttgacattggccagtggagcaaatggtccccggaggtcacaggcactccttggctagcagagcccaggaccactccggcagggatcccggggaaccccacacaggtctctgttgaagactatgacaaccacgaggatcagtacggaagttctacagaagcaacgagtgtcctcgccccagtgcaaggatcctcgcctatacccctgcccacattcctggtagctggaggaagcctggcgtttggattgcttctctgtgtcttcatcatcttgagactcaagaagaaatggaagtcacaggctgagaaggaaagcaagacgacttctcccccaccgtatcccttgggaccgctgaagccgaccttcctcctggttcctctcctcaccccatcagggtcccataacagctctgggactgacaacaccggaagccacagctgcctgggtgtcagggacccacagtgccctaatgacaacagcaacagagactacttattccccagataattgtctggagggtacctggcagctggcacgcaagtttctcactgccggccccgtccaccagggctgggggcggggtgggcggggctgcagcttcacgatcccacaggagccttgcaaaggttctgagtgggagaagactggtgtgctgcacgggcttcgaaagaaggggctgtgaggagcacgagccatcatgaagagagcctgtgatgactctgaatagagacgcccgcccatcagctacacacctgatggtggctctcaagctatcctctcaggaagcctctgggaggggcgacaaaggctgccccagttgcctagctctggctcactggcccaagctgccttttagcttgaactcctaaaatccaagcaccttggccattctcttcctaggccaccgaggccgcggggaagcttggttctactttccttctcaacacctggagaagcagctgcccggtggtggtgactaacgtatcagggcctgatggcttatgaggaatgacaattaattcctcataagcagtttttaaatgtgaatagtaatcctaggcactgctgacttgaggttttattttcttcaatctcaggacttcaggagagaagcagagcagaagtagagagaggatgggtgtccattgtccgtgtggtacttgagggggatacagcctggaaaacacgtttcctgtccccctactctcccagaagaggtagggggtggcgcctcttccagggcagagagtataactactttacctggccttgcccatactggtttcaactggacttgagctactaggaaaaatgacattcatgcaaaaagaaaactttaactagcaagaatgcacttccactttggtttctagaggactgttgctcctcttgagacgctggaagaggccgctcactgtaccctggtgtatgagccctcaccccccaccccagggtaagtgcagtaactttagtctaaacaccgagtcaggtaaaaatcgaggaaaaaacaaccctgtttcctgtaacagaaaagcctttggtttcgttttgtattttgattttttttttgtcttaaaaagtgtaaaaatagtctgtccatactctgcttcagggaatgacctgtgaatactccccaggcgtgggcaggaagggtgtctgcttcctgctacacctcactgccacctcggccttccttgctttacattcaactgagttgcctcagctgctttcccctggggcgctgaaaaagccagtgatgttggtggtcaccgagaagaccacagagccacagagtaatgctgtgattgaagcgagttacgcaaccacagcaccccacatttgctgtattatagaactatgctaggagcttgccttttcacaaaataccaccaccacgagacgtggcagagctcggaagctgtcaccttgtgccatctgcttgccagctccaaggggccactgacttaagcagttattttctttgtgggctttgttcatttcagggcctgttgctgtcttagaaaaagctctgtcggttgacaaaaacatcagacaggtagtcatgtttatttattttttttccttctttgctaagtctttgggactcaagggtagtaaaaaatgctgtgaaaagggaaacattagaaacagcgatcttcggggaataggtgactgtgcccacgcactgttcttcagtccctcacgtggctctgcccgagtgctgttccaagccaggcagagcaggctggcggaagattgaaatccagatagttcgttatctctgagagctaaatagctttgatctccaagctgttattgctttcactattgtaacaggatagcctcccccccccatgtcaaaaggatgcttttcccttttgactttttataagctaagtcagtgaagtctgtttcatctgagctccagcttcgttcagttcgcacaggtgtatgccctcagctgcttcgggcctcagatctgtgctagttgaatggttgtcccatccttgggtcatccttaccagagtttctgcagcccacaggtctgccttgtcaacagtaccacttaacaccagcattcagtgcccaggcagccagatgtggagggtttacccagagatgatttaaacatgaccttaaacgtgtatggtagaacgaggggaacccataccagctcaggttctaaagagatctttgattcttctggcattagtgaaatagctttaaactatttcaaggaagaagccttggccacacccacgacatttggtgacaatcctttctctccatgagccttgtctttacaccttctcacctggctgaaagctcacactgaatctttcctatgtccctggtgtcttgggagaaaggaaactggtatgggcttcactgctggaattggcttggagccagcgtgtggcgcagcgcctggcagggtgggccaggcttagttatggtgtgctggtttaaggaatgcctggcttgcctggttgcttgggttctgagctgcagagtttcctagcagttctttatggctgacctagttggggaagattcccacactcaactgcaggtggaggtggtgagaaagctgttttcatttggagaggcaggatcagcccaagaagctttcagtgggagagcctacagtgaggctgtacctcactgtgggaggaggcaggccagctggctcaggtcctgggactggcactggggagggtctgccaaaggtccctccagcctgtagtcctagcatagtcgggtgccagttccaggaagtttctatggcaaccttagtgctcattaaggaacattgtcagttttgtgaacatatgctcagatggagatcttgttttcagagaaaggactggtacagtgtgtaacaagctggagcagacagagagactttttggcaagagatcacatccgttaagcagaatacctcagtgctacatgtttttgtctttgagacaatgtttttaaggtttttatgctctgttacctgtaagctgatacctaaaactttctgcaaagtcagggtttttcaatgccttttttttttttttgccattgtttgctttaaagtgaagattgtaactgtttgaaataaataatttctaaaactgca

SEQ ID NO: 24 - DNA, 3105 bp, Homo sapiens
caactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggagtccacgtccacccccgagccgcaggcctggtgggcagagacggcccttacgacaagcagcccttcatggtggctttcttcaaagtgagtgaggtgcacgtgcgcaccaccaggtcagcctccagccggcgccgacaacagagtcgtaatcgctctacccagtcccaggacgtggcgcgggtctccagtgcttcagattacaacagcagtgaattgaaaacagcctgcaggaagcatgagctgtatgtgagtttccaagacctgggatggcaggactggatcattgcacccaagggctatgctgccaattactgtgatggagaatgctccttcccactcaacgcacacatgaatgcaaccaaccacgcgattgtgcagaccttggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataatttgctcacttggtaaatgacgtgagtagttgttggtctgtagcaagctgagtttggatgtctgtagcataaggtctggtaactgcagaaacataaccgtgaagctcttcctaccctcctcccccaaaaacccaccaaaattagttttagctgtagatcaagctatttggggtgtttgttagtaaatagggaaaataatctcaaaggagttaaatgtattcttggctaaaggatcagctggttcagtactgtctatcaaaggtagattttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaactgtttgcacttacagctttttttgtaaatataaactataatttattgtctattttatatctgttttgctgtaacattgaaggaaagaccagacttttaaaaaaaaagagtttatttagaaagtatcatagtgtaaacaaacaaattgtaccactttgattttcttggaatacaagactcgtgatgcaaagctgaagttgtgtgtacaagactcttgacagttgtgcttctctaggaggttgggtttttttaaaaaaagaattatctgtgaaccatacgtgattaataaagatttcctttaaggca

SEQ ID NO: 25 - DNA, 2440 bp, Macaca mulatta
agcgcagcccggactcggacgcacctggcctgtaccgcgcgcctctagagacctgcgcggggctgtggggctccccttcctcccctccaagcggttctcccggtgatcgccccttcgccacccctctatcctgggcaactgggggcgccccggacgaccatgagagataaggactgagggccaggaaggggaagcgagcccgccgagaggtggcgggggctgctcacgccaagggccacagcggccgtgctccagcctcgctccgccgctccacgcctcgcgggatccgcgggggcagcccggccgggcggggatgccggggctggggcggagggcgcagtggctgtgctggtggtgggggctgttgtgcagctgctgcgggcccccgccgctgcggccgcccctgcccgctgccgcggccgccgccgccgggggccagctgctgggggacggcgggagccccggccgcacggagcagccgccgccgtcgccgcaatcctcctcgggcttcctctaccggcggctcaagacgcacgagaagcgggagatgcagaaggagatcttgtcggtgctggggctcccacaccggccccggcccctgcacggcctccaacagccgcagcccccggcgctcccgcagcagcagcagcagcagcagcagccgcctcgcggagagccccctcccgggcagctgaagtccgcgcccctcttcatgctggatctgtacaacgccctgtccgccgacgacgaggaggacggggcgtcggagggggagaggcagcagccctggccccacgaaggagccagctcgtcccagcctcggcagccggccccgggcgccgcgcacccgctcaaccgcaagagcctcctggcccccggacctggcagcggcggcgcgtccccactgaccagcgcgcaggacagcgccttcctcaacgacgcagacatggtcatgagctttgtgaacctggtggagtacgacaaggagttctcccctcgtcagcgacaccacaaagagttcaagttcaacttatcccagattcctgagggtgaggcggtgacggctgcagaattccgcatctacaaggactgtgttgtggggagttttaaaaaccaaacttttcttatcagcatttatcaagtcttacaggagcatcagcacagagactctgacctttttttgctggacacccgcgtagtgtgggcctcagaagaaggctggctggaatttgacatcacggccactagcaatctgtgggttgtgaccccgcagcataacatggggcttcagctgagtgtggtgacgcgggatggagtccacatccatccccgagccgcgggcctggtgggcagagacggcccttacgacaagcagcccttcatggtggctttcttcaaagtgagtgaggtccacgtgcgcaccaccaggtcagcctctggccggcgccgacaacagagtcgtaatcgctctacccagtcccaggacgtggcgcgggtctccagtgcttcagattacaacagcagtgaattaaaaacagcttgcaggaagcatgagctgtatgtgagtttccaagacctgggatggcaggactggatcattgcacccaagggctacgctgccaattactgtgatggggaatgctccttcccactcaacgcacacatgaatgcaaccaaccacgcgatcgtgcagaccttggttcaccttatgaaccctgagtatgtccccaaaccgtgctgtgcgccaactaaactaaatgccatctcagttctttactttgatgacaattccaatgtcattctgaaaaaatacaggaatatggttgtaagagcttgtggatgccactaactcgaaaccagatgctggggacacacattctgccttggattcctagattacatctgccttaaaaaacacagaagcacagttggaggtgggacgatgagacttggaaactatctcatgccagtgccttattacccaagaagattttaaaggacctcattaataatttgctcacttggtaaatgacgtgagtagttgttggtctgtagcaagctgagtttggatgtctgtagtgcaaggtccggtaactgcagaaagcaccgtgaagctcttcctcccctcctcccccaaaaacccaccaaaattagttttagctgtagatcaagctatttggggtgttagtaagtagggaaaataatctcaaaggagttaaatgtattcttggttaaagtatcagcctgttcagtactgtctatcaaaggtagattttacagagaacagaaattggggaagttgggggaacgcctctgttcagatttcattcccaggaagttcaatttcatacatgacccacagcccaggccacagccagggctccatggggcgcctttgtctcagtcattgctgttatgtgttcatgctggagttttgttg

SEQ ID NO: 26 - DNA, 2410 bp, Mus musculus
gatcctggccgtcgccccgtcgtctcttctccacccgggcttctgggggcgccgcggatgaccatgagagataaggactgagtgccaggaccgggaagagagcccgccgagaggtggcgggggctgcccactccgagggccacagcctccgcgctccggcctcgctccgccgctcgacgcctcgcgggccccgcgggggcagccgggctgggcggcgatgcccgggctggggcggagggcgcagtggctgtgctggtggtgggggttgctgtgcagctgcggccccccgccactgcggccccctctgccggtagccgcggccgccgccggggggcagctgctgggagccggcgggagcccggtgcgcgctgagcagccaccgccacagtcctcttcttcgggcttcctctatcggcggctcaagacccacgagaagcgggagatgcaaaaggagatcctgtcggtgctggggctcccgcacaggccgcggcccctgcacggtctccagcagcctcagcccccggtgctcccgccacagcagcagcagcagcagcagcagcagcagacggcccgcgaggagccccctccagggcggctgaagtccgctccactcttcatgctggatctctacaacgccctgtccaatgacgacgaagaggatggggcatcggagggtgtggggcaagagcctgggtcccacggaggggccagctcgtcccagctcaggcagccgtctcccggcgctgcacactccttgaaccgcaagagtctcctggccccgggacccggtggcggtgcgtccccactgactagcgcgcaggacagcgctttcctcaacgacgcggacatggtcatgagctttgtgaacctggtggagtacgacaaggagttctccccacatcaacgacaccacaaagagttcaagttcaacctatcccagattcctgagggtgaggcggtgacggctgctgagttccgcgtctacaaggactgtgtggtggggagttttaaaaaccaaacctttcttatcagcatttaccaagtcttgcaggagcatcagcacagagactctgacctatttttgttggacacccgggtggtgtgggcctcagaagaaggttggctggaatttgacatcacagcaactagcaatctgtgggtggtgacaccgcagcacaacatggggctccagctgagtgtggtgactcgggatggactccacgtcaacccccgtgcggcgggcctggtgggcagagacggcccttacgacaagcagcccttcatggtggccttcttcaaggtgagcgaggtccacgtgcgcaccaccaggtcagcctccagtcggcggcggcagcagagtcgcaaccggtccacccagtcgcaggacgtgtcccggggctccggttcttcagactacaacggcagtgagttaaaaacagcttgcaagaagcatgagctctatgtgagcttccaggacctgggatggcaggactggatcattgcacccaaaggctacgctgccaactactgtgatggagagtgttccttcccactcaacgcacacatgaatgccaccaaccacgccattgtacagaccttggtccaccttatgaatcccgagtacgtccccaaaccatgctgcgcaccaaccaaactgaatgccatctcggttctttacttcgatgataactccaatgtcatcttgaaaaagtacaggaatatggtcgtgagagcttgtggttgccattaagttgaagctggtgtgtgtgtgtgggtgggggcatggttctgccttggattcctaacaacaacatctgccttaaaccacgaacaacagcacagcgaagcgggatggtgacacacagagggatcgtgacacgcagacacatctcccgctggtgccttacccacggaggcttttatgaggaccttgtcaagggctttcccagttcctaactgagcagttgctggtctgcaggaagctggaaggcttgtagtacaggcctggaaactgcagttacctaatgttcgcctcccccaaccccgcccggagtagttttagcttttagatctagctgcttgtggtgtaagtagagagtaaacttgaaggaatattaaatatccctgggttgaaagacccggtggtggctctacagcacccatcccagggagatttttgcagacatccgaatggaggggagaagggcactctttcaggttccattcccagcaagggcagctcacacaggacctgcagcctggccatcagcaggctctgtggaggtgccttctgtctactgttgtagttacgtgttttgtgttgactctcggtggtgtgagaatgtactaatctctgtcaagacaaactgtagcatttccaccccatcctcctccctccctcacagaattc

SEQ ID NO: 27 - DNA, 1521 bp, Rattus norvegicus
atgcccgggctggggcggagggcgcagtggctgtgctggtggtgggggttactgtgcagctgcggccccccgccactgcggccccctctgccggtagccgcggccgccgccggggggcagctgctgggagccggcgggagccctgtgcgcgccgagcagccaccgccgcaatcctcctcttcgggcttcctctatcggcggctcaagacccacgagaagcgggagatgcaaaaggagatcctgtcggtgttggggctgcctcacaggccgcggcccctgcacggtctccagcagcctcaatcccccgtgctcccgcagcagcaacaatcgcaacagacggcccgcgaggagccccctccagggcggctgaagtccgctccgctcttcatgctggatctctacaactccctgtccaaggacgacgaagaggatggggtgtcagagggagagggactggagcccgagtcccacggaagggccagctcgtcccagctcaaacagccatctcccggggctgcacactccctgaaccgcaagagtctcctggccccgggacccggcggcagtgcgtccccactgaccagcgcgcaggacagcgctttcctcaacgacgcggacatggtcatgagctttgtgaacctggtggagtacgacaaggagttctccccacgccagcgacaccacaaggagttcaagttcaacttatcccagattcccgagggtgaggcagtgacggctgcagagttccgcgtctacaaggactgtgtggtggggagttttaaaaaccaaacttttcttatcagcatttaccaagtcttacaggagcatcagcacagagactctgacctatttttgttggacacccgggtggtgtgggcctccgaagaaggctggctggaattcgacatcacagcaactagcaatctgtgggtggtgacaccgcagcacaacatgggactccagctgagtgtggtgactcgggacggactccacatcaacccccgtgcggcgggcctggtgggcagagacggcccttacgacaagcagcccttcatggtggccttcttcaaggtgagcgaggtccacgtgcgcaccaccaggtcagcctccagtcggcgtcgacagcagagtcgcaatcggtccacccagtcgcaggacgtgtcccggggctccagtgcttcagactacaacagcagtgagttaaaaacagcttgcaagaagcatgagctttacgtgagcttccaggacctgggatggcaggactggatcatcgcacccaaaggctacgctgccaactattgtgacggagagtgttccttccctctcaatgcacacatgaatgccaccaaccacgccattgtacagaccttggtccaccttatgaatcccgagtacgtccccaaaccatgctgcgcaccaaccaaactgaatgccatctcggttctttacttcgacgacaactccaatgtcatcttgaaaaaatacaggaacatggttgtgagagcttgtggatgtcattga

SEQ ID NO: 28 - DNA, 7057 bp, Homo sapiens
gggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaaaaaaaaaaaaaaaa

SEQ ID NO: 29 - DNA, 7307 bp, Mus musculus
gcccccctcgctctaccgtgaggagcccgagtcggcggcgggtggcggcgcctggaacctggagagaccgagccaccccccggctctcggccggaatgtactgattctcctctgctctcctccccgccccgctgcaggagggaggcgcccggagtctttccccctgggcgcgcgagggggccgcgcgggccgggccgggccgggctggagccgagccctgcggcgcagagaccggctgaggcgcgctgagggaagggcgcgagcgctccgcggcgctatcgccgccgccgccgccgccactcgtggggtagagatggcggcggagcgcgaagccgggcgactcctctgcacctcctcctcccggcgctgctgtccgccaccgccgctgctgctgttgctgccgctgctgctgctgctcggacgcccggcgtccggcgccgcggccacgaagagcggctccccgccgcagtccgcaggagccagtgttcgaacattcactccgttttattttctggtggagccagtagacaccctctcagttagaggctcttctgttatattaaattgctcggcatattctgagccctctccaaacattgaatggaagaaagatgggacttttttaaacttagaatcagatgatcgacgccagctactcccagatggatctttattcatcagcaacgtggtgcattccaaacacaataagcctgacgaaggtttctatcagtgtgtagccactgtggataatcttggaaccattgtcagcagaacagccaagctcacagtagcaggtcttccaagatttaccagccaaccagaaccttcttcagtctatgttggaaacagtgcaattctgaattgtgaagttaatgcagatttggtcccatttgttaggtgggaacagaatcgacagccccttcttctagatgacaggattgtcaaacttccaagtggaacactggttatcagcaatgctactgaaggagatgggggactctaccgctgcattgttgaaagtggtgggccaccaaagtttagtgacgaagctgaattgaaagttcttcaagatcctgaggaaattgtagacttggtatttctgatgcgaccatcttctatgatgaaagtcactggtcagagtgcagtgttgccatgtgttgtctcagggcttcctgctccagttgttagatggatgaaaaacgaagaagtgcttgacacagaaagctctggcaggttggtcttgctagcaggaggttgcttggagatcagtgatgtcactgaggatgatgctgggacttatttttgcatagctgataatggaaataagacagttgaagctcaggcggagcttactgtgcaagtgccacctggattcctgaaacaacctgctaacatatatgctcacgaatccatggacattgtatttgaatgtgaagtcactgggaagccaactccaactgtgaagtgggtcaagaatggggatgtggttatccccagtgattactttaaaattgtaaaggaacataatcttcaagttttgggtctggtgaaatcagatgaagggttctatcaatgcattgctgagaatgatgttggaaatgcacaagctggagcccagctgataatccttgagcatgatgttgccatcccaacattacctcccacttcactgaccagtgccactactgaccatctagcaccagccacaacgggaccattaccttcagctcctcgagacgtcgtggcctccctggtctctactcgcttcattaaattgacatggcgtacacctgcatcagaccctcatggagacaatctcacctactctgtgttctacaccaaggaaggggttgctagggagcgtgttgagaataccagccagccaggagagatgcaggtgactattcaaaacttgatgccagcaactgtgtacatcttcaaagttatggctcaaaataagcatggctctggagaaagttcagctcctcttcgagtagagacacagcctgaggttcagctccctggcccagcacctaatatccgtgcttatgcaacgtcacctacttctatcactgtcacctgggaaacaccgttatctggcaatggggaaattcaaaattacaaattgtactacatggaaaaaggaactgataaagaacaggatattgatgtttcaagtcactcctacaccattaatggactgaagaaatacacagaatacagtttccgagtggtggcctacaataaacatggtcctggagtttctacacaagatgttgctgttcgaacattatcagatgttcccagtgctgctcctcagaatctgtccttagaagtgagaaattcaaagagtatagtgatccactggcagcccccttcctcaaccacacaaaatgggcagataactggctacaagattcgatatcgaaaggcctcccgaaaaagtgatgtcactgagaccttggtaactgggacacagctgtctcagctgattgaaggtcttgatcgggggacagaatataacttccgagtcgctgctctcacagtcaatggtacaggtccagcaactgattggctgtctgctgaaacttttgaaagcgacctagatgaaactcgtgttcctgaagtgcccagctctcttcatgtccgtccgctcgtcactagcattgtagtgagctggactcctccagagaaccagaacattgtggtccgaggttatgccatcggttacggcattggcagccctcatgcccagaccatcaaagtggactataaacaacgttattacaccatcgaaaacttggatccaagctctcattacgtgattaccttgaaagcatttaacaatgttggcgaaggcatccccctttatgagagtgctgtgaccagacctcacacagtgccagatcccactcccatgatgccaccagtgggagttcaggcttccattctgagtcacgacaccataaggattacctgggcagacaactccctgcccaaacaccagaagattacagactcccgctactacacagtccggtggaagaccaacatcccagcaaacacgaagtacaagaatgcaaatgcaacgacgttaagctatttggttactggtttaaagccaaatacgctctatgagttctctgtgatggtgaccaaaggcagaaggtcaagcacgtggagtatgacagctcatggcgctacctttgaattagttcctacttctccacctaaggatgtgacagttgtgagtaaggaaggaaaacctagaaccatcatagtgaattggcagcctccctctgaagctaacggcaagattacaggttacatcatctattacagcacggatgtgaatgcagagatacatgactgggttattgaaccagttgtgggaaacagactgactcaccagattcaagagttaacacttgatacgccatactacttcaaaatccaggcccggaactcaaagggcatggggcccatgtctgaagctgtacagttcagaacacctaaagccttagggtcagcaggaaaaggaagccgactaccagacctgggatctgactacaaacctccaatgagtggcagcaacagccctcacgggagccccacctcccctctggacagcaacatgctgctggtcatcattgtctctgttggcgtcatcactatcgtggtggttgtggtcattgctgtcttttgtacccggcgcaccacctctcaccagaagaagaaacgagctgcgtgcaaatcagtgaatggctcccataagtacaagggcaattgcaaagatgtgaagcctccagacctatggatccatcacgagagactagagttgaagcctattgacaagtctccagatcctaaccctgtcatgactgatactccaatccctcgaaactctcaagatatcacaccagtggacaattccatggatagcaatatccatcaaaggcggaattcatacagagggcatgagtcagaggacagcatgtctacactggctggaaggaggggaatgagaccaaaaatgatgatgccctttgactctcagccacctcagcctgtgattagtgcccatcccatccattccctcgataaccctcaccatcatttccactccagcagcctcgcttctccagcccgcagtcatctctaccacccaagcagcccatggcccattggcacatccatgtccctttcagacagggccaattccacagaatctgttcgaaatacccccagcacggacaccatgccagcgtcctcgtctcagacgtgctgcactgaccatcaggaccctgagggtgctactagctcctcttacttggccagctcccaagaggaagactcaggccagagtcttcccacagcccatgtccgcccttcccaccctctgaagagcttcgctgtgccagcaatcccacccccaggacctcctctctatgatcctgcactgccaagcacaccattactgtcccagcaagctctgaaccatcacattcactcagtgaaaacagcctccatcgggacgttaggaaggagccggcctcctatgccagtggttgttccgagtgcccctgaagtacaggagaccaccaggatgctggaagactccgagagtagctatgaaccagatgagctgaccaaagagatggcccacctggaaggactaatgaaggacctaaatgccatcacaacagcctgatgaccttcgcctggacatgactccaagcctgagtctacaagtctcggaacttaaccttgaaaacaaggaattgtacagagtacgagaggacagcacttgagagcaggagccagcaaaccagccagtgcctccatgtggggttggctccaggcacagccacctgccttctcctggtcagcctggattacacttgtgtggaggcagcttccctttgcctgctgagagcctgcaggactgggcactatgggccaaaattttgtgtccagggaagaggcaagaagtacgacctgccttttgctttgtggtcagtggcttgtgtctttgtgctgcaactgcatcacttttatggagtgtagacattggcatttatgtacaattttgtgtcctattttattttaccttaaaacactatcagaagccaagggagtctgtgatgttctctcaagcagttgacacttgactgtggttccagttacttacggaaagtcatcaacagtgaggttgtttgacaccactgacaggcattggcttgttgtgggtttcatttttattcttaattctgagacattgcatcctctgccagctgttaatccatcactttgaggggaggacatgttgcattgctgtttgtaagcttttttattatttttttattataattattaaaggcctgactttctcctctcatcactgtgagattacagatctatttgaatgaaatgtaacattgaaaagacttgtttgttgctttctgtgcagattcagtattggggtgggattggggattgggaataggaaatggaggggctgctgaggccctgtgaatgtttctgtcaatgtactttgttccagaagcctgccgagaatgaaagcagcatctttagtgtcctttcctggcatttccatcttcgtgtcactgcatagcaactggagttttgtttggatctggttataaattcttgtacagtggatgactttggtgatttagctgccctggtatcttggtcatttcctctttggagtgtccacactgaggtctctatcaatgtatgtttaattgcttgagagatgccaagtagaaccagagcctgactgtgctctgagaagctacaaagcacagggtggagactccctttgtgttgctagtattggttctctctggaaggttaaaatctaaggcaggatcttggtttcctattccaaataggatgcctgcttctctgggcaccagtcctcagccaggcagctctcgtggcattgcagaggctctcctgaaaaacatcaaccagggtgagagccaagatggggtggcacccatgacgcttccccacatgtttcttcaaggagcagaggacagagatagtggaaagagggtcagcagaagcaggtgccttcatctatcccagcagctcagccaaaccccagttagaatgaggcagcaggagattccaggtgtgctgagggttcagccacacgcagaagacgttgcagagtgttaaagaggtaagctgaggtgtgtatttggttggctttgttgttgttgttaatgtataatgaaaagtataagactaaccctcaggcctcatgttctccaatagatccctggaagacagtatagaaagtcagtcgggcttgggctccttagccagtgagactactcagaccaccagtggctagcctagcctacctgtccttgaacatgggtgattttacccctttgaggtcttaaccctttttttactttcaacaagatgagctctttgtatgattgcgggcgggggatatgaaaatgcaatgatctaactcctgttgctcttctagctggtcacatgacggcaccaggcagggttctgggacacccggtgtgctttgactgttctacaaaaagctgtcagagcgttctggcctcctggaggctagattcctcagaaactgtctagcctttgcccacagagcatgctatgtaattagagcactccttcccatgaaccccagcacttgtgttacctcagggccttggtacctggatactgccacagaatttccatggggcgggaagggatgtatttttaaataaagtaacttaaaagttggggaaattttttaaattcagaaaatgcaaagctattctgtattacaccatttcacaatttaatatgtcttatattttcctgtgactctggaaactaaaccattgtgtgtcttgtcgtgtcctagttgagctggggcctagcagcttccttccagtgggtgtggagcaaacgtgtatgtcgcctcgctacctgcttgaggggtccgaagggctgctgggactgagttctgtacacacttgtttggccttttctgtagttgatgctgtaaaactctatggctttttaaaaacaatttcatgtttttattttgtattggaagtccaatacacttttttaatccaatcaaactggtctggtcaaaaagttctttcccttaaaagttcaggggctcctacttccagcttccgatgacttctctgtggctctcactgctataaagcaggatttagaatggcaatctgggcagaggtaataaaagaaatgtctgactgccagccccaaaa

SEQ ID NO: 30 - DNA, 21 bp, Artificial Sequence
  Description of Artificial Sequence: Synthetic oligonucleotide
  Description of Combined DNA/RNA Molecule: Synthetic oligonucleotide
gaacauaggucuuggaauatt

SEQ ID NO: 31 - DNA, 21 bp, Artificial Sequence
  Description of Artificial Sequence: Synthetic oligonucleotide
  Description of Combined DNA/RNA Molecule: Synthetic oligonucleotide
agaguagggaaucauggcutt

SEQ ID NO: 32 - RNA, 19 nt, Artificial Sequence
  Description of Artificial Sequence: Synthetic oligonucleotide
agaguagggaaucauggcu

SEQ ID NO: 33 - DNA, 21 bp, Artificial Sequence
  Description of Artificial Sequence: Synthetic oligonucleotide
  Description of Combined DNA/RNA Molecule: Synthetic oligonucleotide
agccaugauucccuacucutt

SEQ ID NO: 34 - RNA, 19 nt, Artificial Sequence
  Description of Artificial Sequence: Synthetic oligonucleotide
agccaugauucccuacucu

SEQ ID NO: 35 - DNA, 21 bp, Artificial Sequence
  Description of Artificial Sequence: Synthetic oligonucleotide
  Description of Combined DNA/RNA Molecule: Synthetic oligonucleotide
caggcagccaaaccucauutt

SEQ ID NO: 36 - RNA, 19 nt, Artificial Sequence
  Description of Artificial Sequence: Synthetic oligonucleotide
caggcagccaaaccucauu

SEQ ID NO: 37 - RNA, 19 nt, Artificial Sequence
  Description of Artificial Sequence: Synthetic oligonucleotide
aaugagguuuggcugccug

SEQ ID NO: 38 - DNA, 21 bp, Artificial Sequence
  Description of Artificial Sequence: Synthetic oligonucleotide
  Description of Combined DNA/RNA Molecule: Synthetic oligonucleotide
aaugagguuuggcugccugtt

SEQ ID NO: 39 - DNA, 18 bp, Artificial Sequence
  Description of Artificial Sequence: Synthetic primer
ctccgttttcccacaaca

SEQ ID NO: 40 - DNA, 18 bp, Artificial Sequence
  Description of Artificial Sequence: Synthetic primer
cagcacatcccacacttt

SEQ ID NO: 41 - DNA, 21 bp, Artificial Sequence
  Description of Artificial Sequence: Synthetic primer
acccacttccccatctgcatt

SEQ ID NO: 42 - DNA, 21 bp, Artificial Sequence
  Description of Artificial Sequence: Synthetic oligonucleotide
  Description of Combined DNA/RNA Molecule: Synthetic oligonucleotide
ugcuguaacaauucccagutt

SEQ ID NO: 43 - DNA, 21 bp, Artificial Sequence
  Description of Artificial Sequence: Synthetic oligonucleotide
  Description of Combined DNA/RNA Molecule: Synthetic oligonucleotide
acugggaauuguuacagcatt

SEQ ID NO: 44 - DNA, 21 bp, Artificial Sequence
  Description of Artificial Sequence: Synthetic oligonucleotide
  Description of Combined DNA/RNA Molecule: Synthetic oligonucleotide
uauuccaagaccuauguuctt

SEQ ID NO: 45 - DNA, 21 bp, Artificial Sequence
  Description of Artificial Sequence: Synthetic oligonucleotide
  Description of Combined DNA/RNA Molecule: Synthetic oligonucleotide
ccacgugauucuccuuucutt

SEQ ID NO: 46 - DNA, 21 bp, Artificial Sequence
  Description of Artificial Sequence: Synthetic oligonucleotide
  Description of Combined DNA/RNA Molecule: Synthetic oligonucleotide
agaaaggagaaucacguggtt

SEQ ID NO: 47 - DNA, 21 bp, Artificial Sequence
  Description of Artificial Sequence: Synthetic oligonucleotide
  Description of Combined DNA/RNA Molecule: Synthetic oligonucleotide
ccuucaaucaaacccaguutt

SEQ ID NO: 48 - DNA, 21 bp, Artificial Sequence
  Description of Artificial Sequence: Synthetic oligonucleotide
  Description of Combined DNA/RNA Molecule: Synthetic oligonucleotide
aacuggguuugauugaaggtt

SEQ ID NO: 49 - DNA, 21 bp, Artificial Sequence
  Description of Artificial Sequence: Synthetic oligonucleotide
  Description of Combined DNA/RNA Molecule: Synthetic oligonucleotide
uuuucuccaguuaaguucatt

SEQ ID NO: 50 - RNA, 19 nt, Artificial Sequence
  Description of Artificial Sequence: Synthetic oligonucleotide
uuuucuccaguuaaguuca

SEQ ID NO: 51 - DNA, 21 bp, Artificial Sequence
  Description of Artificial Sequence: Synthetic oligonucleotide
  Description of Combined DNA/RNA Molecule: Synthetic oligonucleotide
ugaacuuaacuggagaaaatt

SEQ ID NO: 52 - RNA, 19 nt, Artificial Sequence
  Description of Artificial Sequence: Synthetic oligonucleotide
ugaacuuaacuggagaaaa

SEQ ID NO: 53 - RNA, 19 nt, Artificial Sequence
  Description of Artificial Sequence: Synthetic oligonucleotide
ggaugugcugcaagacgua

SEQ ID NO: 54 - RNA, 19 nt, Artificial Sequence
  Description of Artificial Sequence: Synthetic oligonucleotide
augugcugcaagacguaga

SEQ ID NO: 55 - RNA, 19 nt, Artificial Sequence
  Description of Artificial Sequence: Synthetic oligonucleotide
ugugcugcaagacguagaa

SEQ ID NO: 56 - RNA, 19 nt, Artificial Sequence
  Description of Artificial Sequence: Synthetic oligonucleotide
gcugcaagacguagaaccu

SEQ ID NO: 57 - RNA, 19 nt, Artificial Sequence
  Description of Artificial Sequence: Synthetic oligonucleotide
cugcaagacguagaaccua

SEQ ID NO: 58 - RNA, 19 nt, Artificial Sequence
  Description of Artificial Sequence: Synthetic oligonucleotide
cguagaaccuaccugcccu

SEQ ID NO: 59 - RNA, 19 nt, Artificial Sequence
  Description of Artificial Sequence: Synthetic oligonucleotide
guccccucccuuccuuauu

SEQ ID NO: 60 - RNA, 19 nt, Artificial Sequence
  Description of Artificial Sequence: Synthetic oligonucleotide
uccccucccuuccuuauuu

SEQ ID NO: 61 - RNA, 19 nt, Artificial Sequence
  Description of Artificial Sequence: Synthetic oligonucleotide
ccccucccuuccuuauuua

SEQ ID NO: 62 - RNA, 19 nt, Artificial Sequence
  Description of Artificial Sequence: Synthetic oligonucleotide
cccucccuuccuuauuuau

SEQ ID NO: 63 - RNA, 19 nt, Artificial Sequence
  Description of Artificial Sequence: Synthetic oligonucleotide
ccucccuuccuuauuuauu

SEQ ID NO: 64 - RNA, 19 nt, Artificial Sequence
  Description of Artificial Sequence: Synthetic oligonucleotide
cucccuuccuuauuuauua

SEQ ID NO: 65 - RNA, 19 nt, Artificial Sequence
  Description of Artificial Sequence: Synthetic oligonucleotide
cucccuuccuuauuuauuu

SEQ ID NO: 66 - RNA, 19 nt, Artificial Sequence
  Description of Artificial Sequence: Synthetic oligonucleotide
cccuuccuuauuuauuccu

SEQ ID NO: 67 - RNA, 19 nt, Artificial Sequence
  Description of Artificial Sequence: Synthetic oligonucleotide
ccuuccuuauuuauuccua

SEQ ID NO: 68 - RNA, 19 nt, Artificial Sequence
  Description of Artificial Sequence: Synthetic oligonucleotide
ccuuccuuauuuauuccuu

SEQ ID NO: 69 - RNA, 19 nt, Artificial Sequence
  Description of Artificial Sequence: Synthetic oligonucleotide
cuuccuuauuuauuccuga

SEQ ID NO: 70 - RNA, 19 nt, Artificial Sequence
  Description of Artificial Sequence: Synthetic oligonucleotide
cuuccuuauuuauuccugu

SEQ ID NO: 71 - RNA, 19 nt, Artificial Sequence
  Description of Artificial Sequence: Synthetic oligonucleotide
uuccuuauuuauuccugcu

SEQ ID NO: 72 - RNA, 19 nt, Artificial Sequence
  Description of Artificial Sequence: Synthetic oligonucleotide
uccuuauuuauuccugcua

SEQ ID NO: 73 - RNA, 19 nt, Artificial Sequence
  Description of Artificial Sequence: Synthetic oligonucleotide
uccuuauuuauuccugcuu

SEQ ID NO: 74 - RNA, 19 nt, Artificial Sequence
  Description of Artificial Sequence: Synthetic oligonucleotide
ccuuauuuauuccugcuga

SEQ ID NO: 75 - RNA, 19 nt, Artificial Sequence
  Description of Artificial Sequence: Synthetic oligonucleotide
ccuuauuuauuccugcugu

SEQ ID NO: 76 - RNA, 19 nt, Artificial Sequence
  Description of Artificial Sequence: Synthetic oligonucleotide
auuuauuccugcugcccca

SEQ ID NO: 77 - RNA, 19 nt, Artificial Sequence
  Description of Artificial Sequence: Synthetic oligonucleotide
uuauuccugcugccccaga

SEQ ID NO: 78 - RNA, 19 nt, Artificial Sequence
  Description of Artificial Sequence: Synthetic oligonucleotide
uauuccugcugccccagaa

SEQ ID NO: 79 - RNA, 19 nt, Artificial Sequence
  Description of Artificial Sequence: Synthetic oligonucleotide
uccugcugccccagaacau

SEQ ID NO: 80 - RNA, 19 nt, Artificial Sequence
  Description of Artificial Sequence: Synthetic oligonucleotide
ccugcugccccagaacaua

SEQ ID NO: 81 - RNA, 19 nt, Artificial Sequence
  Description of Artificial Sequence: Synthetic oligonucleotide
gcugccccagaacauaggu

SEQ ID NO: 82 - RNA, 19 nt, Artificial Sequence
  Description of Artificial Sequence: Synthetic oligonucleotide
ugccccagaacauaggucu

SEQ ID NO: 83 - RNA, 19 nt, Artificial Sequence
  Description of Artificial Sequence: Synthetic oligonucleotide
gccccagaacauaggucuu

SEQ ID NO: 84 - RNA, 19 nt, Artificial Sequence
  Description of Artificial Sequence: Synthetic oligonucleotide
ccagaacauaggucuugga

SEQ ID NO: 85 - RNA, 19 nt, Artificial Sequence
  Description of Artificial Sequence: Synthetic oligonucleotide
cagaacauaggucuuggaa

SEQ ID NO: 86 - RNA, 19 nt, Artificial Sequence
  Description of Artificial Sequence: Synthetic oligonucleotide
agaacauaggucuuggaau

SEQ ID NO: 87 - RNA, 19 nt, Artificial Sequence
  Description of Artificial Sequence: Synthetic oligonucleotide
gaacauaggucuuggaaua

SEQ ID NO: 88 - RNA, 19 nt, Artificial Sequence
  Description of Artificial Sequence: Synthetic oligonucleotide
aacauaggucuuggaauaa

SEQ ID NO: 89 - RNA, 19 nt, Artificial Sequence
  Description of Artificial Sequence: Synthetic oligonucleotide
gaauaaaauggcugguucu

SEQ ID NO: 90 - RNA, 19 nt, Artificial Sequence
  Description of Artificial Sequence: Synthetic oligonucleotide
auaaaauggcugguucuuu

SEQ ID NO: 91 - RNA, 19 nt, Artificial Sequence
  Description of Artificial Sequence: Synthetic oligonucleotide
uaaaauggcugguucuuuu

SEQ ID NO: 92 - RNA, 19 nt, Artificial Sequence
  Description of Artificial Sequence: Synthetic oligonucleotide
aauggcugguucuuuuguu

SEQ ID NO: 93 - RNA, 19 nt, Artificial Sequence
  Description of Artificial Sequence: Synthetic oligonucleotide
auggcugguucuuuuguuu

SEQ ID NO: 94 - RNA, 19 nt, Artificial Sequence
  Description of Artificial Sequence: Synthetic oligonucleotide
cugguucuuuuguuuucca

SEQ ID NO: 95 - RNA, 19 nt, Artificial Sequence
  Description of Artificial Sequence: Synthetic oligonucleotide
caucgaucaaaguguggga

SEQ ID NO: 96 - RNA, 19 nt, Artificial Sequence
  Description of Artificial Sequence: Synthetic oligonucleotide
uacgucuugcagcacaucc

SEQ ID NO: 97 - RNA, 19 nt, Artificial Sequence
  Description of Artificial Sequence: Synthetic oligonucleotide
ucuacgucuugcagcacau

SEQ ID NO: 98 - RNA, 19 nt, Artificial Sequence
  Description of Artificial Sequence: Synthetic oligonucleotide
uucuacgucuugcagcaca

SEQ ID NO: 99 - RNA, 19 nt, Artificial Sequence
  Description of Artificial Sequence: Synthetic oligonucleotide
agguucuacgucuugcagc

SEQ ID NO: 100 - RNA, 19 nt, Artificial Sequence
  Description of Artificial Sequence: Synthetic oligonucleotide
uagguucuacgucuugcag

SEQ ID NO: 101 - RNA, 19 nt, Artificial Sequence
  Description of Artificial Sequence: Synthetic oligonucleotide
agggcagguagguucuacg

SEQ ID NO: 102 - RNA, 19 nt, Artificial Sequence
  Description of Artificial Sequence: Synthetic oligonucleotide
aauaaggaagggaggggac

SEQ ID NO: 103 - RNA, 19 nt, Artificial Sequence
  Description of Artificial Sequence: Synthetic oligonucleotide
aaauaaggaagggagggga

SEQ ID NO: 104 - RNA, 19 nt, Artificial Sequence
  Description of Artificial Sequence: Synthetic oligonucleotide
uaaauaaggaagggagggg

SEQ ID NO: 105 - RNA, 19 nt, Artificial Sequence
  Description of Artificial Sequence: Synthetic oligonucleotide
auaaauaaggaagggaggg

SEQ ID NO: 106 - RNA, 19 nt, Artificial Sequence
  Description of Artificial Sequence: Synthetic oligonucleotide
aauaaauaaggaagggagg

SEQ ID NO: 107 - RNA, 19 nt, Artificial Sequence
  Description of Artificial Sequence: Synthetic oligonucleotide
uaauaaauaaggaagggag

SEQ ID NO: 108 - RNA, 19 nt, Artificial Sequence
  Description of Artificial Sequence: Synthetic oligonucleotide
aaauaaauaaggaagggag

SEQ ID NO: 109 - RNA, 19 nt, Artificial Sequence
  Description of Artificial Sequence: Synthetic oligonucleotide
aggaauaaauaaggaaggg

SEQ ID NO: 110 - RNA, 19 nt, Artificial Sequence
  Description of Artificial Sequence: Synthetic oligonucleotide
uaggaauaaauaaggaagg

SEQ ID NO: 111 - RNA, 19 nt, Artificial Sequence
  Description of Artificial Sequence: Synthetic oligonucleotide
aaggaauaaauaaggaagg

SEQ ID NO: 112 - RNA, 19 nt, Artificial Sequence
  Description of Artificial Sequence: Synthetic oligonucleotide
ucaggaauaaauaaggaag

SEQ ID NO: 113 - RNA, 19 nt, Artificial Sequence
  Description of Artificial Sequence: Synthetic oligonucleotide
acaggaauaaauaaggaag

SEQ ID NO: 114 - RNA, 19 nt, Artificial Sequence
  Description of Artificial Sequence: Synthetic oligonucleotide
agcaggaauaaauaaggaa

SEQ ID NO: 115 - RNA, 19 nt, Artificial Sequence
  Description of Artificial Sequence: Synthetic oligonucleotide
uagcaggaauaaauaagga

SEQ ID NO: 116 - RNA, 19 nt, Artificial Sequence
  Description of Artificial Sequence: Synthetic oligonucleotide
aagcaggaauaaauaagga

SEQ ID NO: 117 - RNA, 19 nt, Artificial Sequence
  Description of Artificial Sequence: Synthetic oligonucleotide
ucagcaggaauaaauaagg

SEQ ID NO: 118 - RNA, 19 nt, Artificial Sequence
  Description of Artificial Sequence: Synthetic oligonucleotide
acagcaggaauaaauaagg

SEQ ID NO: 119 - RNA, 19 nt, Artificial Sequence
  Description of Artificial Sequence: Synthetic oligonucleotide
uggggcagcaggaauaaau

SEQ ID NO: 120 - RNA, 19 nt, Artificial Sequence
  Description of Artificial Sequence: Synthetic oligonucleotide
ucuggggcagcaggaauaa

SEQ ID NO: 121 - RNA, 19 nt, Artificial Sequence
  Description of Artificial Sequence: Synthetic oligonucleotide
uucuggggcagcaggaaua

SEQ ID NO: 122 - RNA, 19 nt, Artificial Sequence
  Description of Artificial Sequence: Synthetic oligonucleotide
auguucuggggcagcagga

SEQ ID NO: 123 - RNA, 19 nt, Artificial Sequence
  Description of Artificial Sequence: Synthetic oligonucleotide
uauguucuggggcagcagg

SEQ ID NO: 124 - RNA, 19 nt, Artificial Sequence
  Description of Artificial Sequence: Synthetic oligonucleotide
accuauguucuggggcagc

SEQ ID NO: 125 - RNA, 19 nt, Artificial Sequence
  Description of Artificial Sequence: Synthetic oligonucleotide
agaccuauguucuggggca

SEQ ID NO: 126 - RNA, 19 nt, Artificial Sequence
  Description of Artificial Sequence: Synthetic oligonucleotide
aagaccuauguucuggggc

SEQ ID NO: 127 - RNA, 19 nt, Artificial Sequence
  Description of Artificial Sequence: Synthetic oligonucleotide
uccaagaccuauguucugg

SEQ ID NO: 128 - RNA, 19 nt, Artificial Sequence
  Description of Artificial Sequence: Synthetic oligonucleotide
uuccaagaccuauguucug

SEQ ID NO: 129 - RNA, 19 nt, Artificial Sequence
  Description of Artificial Sequence: Synthetic oligonucleotide
auuccaagaccuauguucu

SEQ ID NO: 130 - RNA, 19 nt, Artificial Sequence
  Description of Artificial Sequence: Synthetic oligonucleotide
uauuccaagaccuauguuc

SEQ ID NO: 131 - RNA, 19 nt, Artificial Sequence
  Description of Artificial Sequence: Synthetic oligonucleotide
uuauuccaagaccuauguu

SEQ ID NO: 132 - RNA, 19 nt, Artificial Sequence
  Description of Artificial Sequence: Synthetic oligonucleotide
agaaccagccauuuuauuc

SEQ ID NO: 133 - RNA, 19 nt, Artificial Sequence
  Description of Artificial Sequence: Synthetic oligonucleotide
aaagaaccagccauuuuau

SEQ ID NO: 134 - RNA, 19 nt, Artificial Sequence
  Description of Artificial Sequence: Synthetic oligonucleotide
aaaagaaccagccauuuua

SEQ ID NO: 135 - RNA, 19 nt, Artificial Sequence
  Description of Artificial Sequence: Synthetic oligonucleotide
aacaaaagaaccagccauu

SEQ ID NO: 136 - RNA, 19 nt, Artificial Sequence
  Description of Artificial Sequence: Synthetic oligonucleotide
aaacaaaagaaccagccau

SEQ ID NO: 137 - RNA, 19 nt, Artificial Sequence
  Description of Artificial Sequence: Synthetic oligonucleotide
uggaaaacaaaagaaccag

SEQ ID NO: 138 - RNA, 19 nt, Artificial Sequence
  Description of Artificial Sequence: Synthetic oligonucleotide
ucccacacuuugaucgaug

SEQ ID NO: 139 - RNA, 19 nt, Artificial Sequence
  Description of Artificial Sequence: Synthetic oligonucleotide
agacggcacgauggcacuu

SEQ ID NO: 140 - RNA, 19 nt, Artificial Sequence
  Description of Artificial Sequence: Synthetic oligonucleotide
gcacgauggcacugagcua

SEQ ID NO: 141 - RNA, 19 nt, Artificial Sequence
  Description of Artificial Sequence: Synthetic oligonucleotide
gcacgauggcacugagcuu

SEQ ID NO: 142 - RNA, 19 nt, Artificial Sequence
  Description of Artificial Sequence: Synthetic oligonucleotide
ggcacugagcucccagaua

SEQ ID NO: 143 - RNA, 19 nt, Artificial Sequence
  Description of Artificial Sequence: Synthetic oligonucleotide
ggcacugagcucccagauu

SEQ ID NO: 144 - RNA, 19 nt, Artificial Sequence
  Description of Artificial Sequence: Synthetic oligonucleotide
cacugagcucccagaucua

SEQ ID NO: 145 - RNA, 19 nt, Artificial Sequence
  Description of Artificial Sequence: Synthetic oligonucleotide
cacugagcucccagaucuu

SEQ ID NO: 146 - RNA, 19 nt, Artificial Sequence
  Description of Artificial Sequence: Synthetic oligonucleotide
cugaccaguggcucuguuu

SEQ ID NO: 147 - RNA, 19 nt, Artificial Sequence
  Description of Artificial Sequence: Synthetic oligonucleotide
uggcucuguuuucccacaa

SEQ ID NO: 148 - RNA, 19 nt, Artificial Sequence
  Description of Artificial Sequence: Synthetic oligonucleotide
uguuuucccacaacagaca

SEQ ID NO: 149 - RNA, 19 nt, Artificial Sequence
  Description of Artificial Sequence: Synthetic oligonucleotide
uguuuucccacaacagacu

SEQ ID NO: 150 - RNA, 19 nt, Artificial Sequence
  Description of Artificial Sequence: Synthetic oligonucleotide
acaacagacgggacaacuu

SEQ ID NO: 151 - RNA, 19 nt, Artificial Sequence
  Description of Artificial Sequence: Synthetic oligonucleotide
aacagacgggacaacuuga

SEQ ID NO: 152 - RNA, 19 nt, Artificial Sequence
  Description of Artificial Sequence: Synthetic oligonucleotide
aacagacgggacaacuugu

SEQ ID NO: 153 - RNA, 19 nt, Artificial Sequence
  Description of Artificial Sequence: Synthetic oligonucleotide
agacgggacaacuugcaga

SEQ ID NO: 154 - RNA, 19 nt, Artificial Sequence
  Description of Artificial Sequence: Synthetic oligonucleotide
gacgggacaacuugcagaa

SEQ ID NO: 155 - RNA, 19 nt, Artificial Sequence
  Description of Artificial Sequence: Synthetic oligonucleotide
gacgggacaacuugcagau

SEQ ID NO: 156 - RNA, 19 nt, Artificial Sequence
  Description of Artificial Sequence: Synthetic oligonucleotide
acgggacaacuugcagaga

SEQ ID NO: 157 - RNA, 19 nt, Artificial Sequence
  Description of Artificial Sequence: Synthetic oligonucleotide
acgggacaacuugcagagu

SEQ ID NO: 158 - RNA, 19 nt, Artificial Sequence
  Description of Artificial Sequence: Synthetic oligonucleotide
gaggcgagacacccacuua

SEQ ID NO: 159 - RNA, 19 nt, Artificial Sequence
  Description of Artificial Sequence: Synthetic oligonucleotide
gaggcgagacacccacuuu

SEQ ID NO: 160 - RNA, 19 nt, Artificial Sequence
  Description of Artificial Sequence: Synthetic oligonucleotide
cccacuuccccaucugcau

SEQ ID NO: 161 - RNA, 19 nt, Artificial Sequence
  Description of Artificial Sequence: Synthetic oligonucleotide
uuccccaucugcauuuucu

SEQ ID NO: 162 - RNA, 19 nt, Artificial Sequence
  Description of Artificial Sequence: Synthetic oligonucleotide
cccaucugcauuuucugcu

SEQ ID NO: 163 - RNA, 19 nt, Artificial Sequence
  Description of Artificial Sequence: Synthetic oligonucleotide
cugcugcggcugcugucau

SEQ ID NO: 164 - RNA, 19 nt, Artificial Sequence
  Description of Artificial Sequence: Synthetic oligonucleotide
ugcugcggcugcugucaua

SEQ ID NO: 165 - RNA, 19 nt, Artificial Sequence
  Description of Artificial Sequence: Synthetic oligonucleotide
ugcugcggcugcugucauu

SEQ ID NO: 166 - RNA, 19 nt, Artificial Sequence
  Description of Artificial Sequence: Synthetic oligonucleotide
cugcggcugcugucaucga

SEQ ID NO: 167 - RNA, 19 nt, Artificial Sequence
  Description of Artificial Sequence: Synthetic oligonucleotide
ugcggcugcugucaucgau

SEQ ID NO: 168 - RNA, 19 nt, Artificial Sequence
  Description of Artificial Sequence: Synthetic oligonucleotide
gcggcugcugucaucgaua

SEQ ID NO: 169 - RNA, 19 nt, Artificial Sequence
  Description of Artificial Sequence: Synthetic oligonucleotide
gcggcugcugucaucgauu

SEQ ID NO: 170 - RNA, 19 nt, Artificial Sequence
  Description of Artificial Sequence: Synthetic oligonucleotide
cggcugcugucaucgauca

SEQ ID NO: 171 - RNA, 19 nt, Artificial Sequence
  Description of Artificial Sequence: Synthetic oligonucleotide
ggcugcugucaucgaucaa

SEQ ID NO: 172 - RNA, 19 nt, Artificial Sequence
  Description of Artificial Sequence: Synthetic oligonucleotide
gcugcugucaucgaucaaa

SEQ ID NO: 173 - RNA, 19 nt, Artificial Sequence
  Description of Artificial Sequence: Synthetic oligonucleotide
cugcugucaucgaucaaaa

SEQ ID NO: 174 - RNA, 19 nt, Artificial Sequence
  Description of Artificial Sequence: Synthetic oligonucleotide
cugcugucaucgaucaaau

SEQ ID NO: 175 - RNA, 19 nt, Artificial Sequence
  Description of Artificial Sequence: Synthetic oligonucleotide
ugcugucaucgaucaaagu

SEQ ID NO: 176 - RNA, 19 nt, Artificial Sequence
  Description of Artificial Sequence: Synthetic oligonucleotide
gcugucaucgaucaaagua

SEQ ID NO: 177 - RNA, 19 nt, Artificial Sequence
  Description of Artificial Sequence: Synthetic oligonucleotide
gcugucaucgaucaaaguu

SEQ ID NO: 178 - RNA, 19 nt, Artificial Sequence
  Description of Artificial Sequence: Synthetic oligonucleotide
cugucaucgaucaaagugu

SEQ ID NO: 179 - RNA, 19 nt, Artificial Sequence
  Description of Artificial Sequence: Synthetic oligonucleotide
ugucaucgaucaaagugua

SEQ ID NO: 180 - RNA, 19 nt, Artificial Sequence
  Description of Artificial Sequence: Synthetic oligonucleotide
ugucaucgaucaaaguguu

SEQ ID NO: 181 - RNA, 19 nt, Artificial Sequence
  Description of Artificial Sequence: Synthetic oligonucleotide
ucaucgaucaaagugugga

SEQ ID NO: 182 - RNA, 19 nt, Artificial Sequence
  Description of Artificial Sequence: Synthetic oligonucleotide
ucaucgaucaaaguguggu

SEQ ID NO: 183 - RNA, 19 nt, Artificial Sequence
  Description of Artificial Sequence: Synthetic oligonucleotide
gaucaaagugugggaugua

SEQ ID NO: 184 - RNA, 19 nt, Artificial Sequence
  Description of Artificial Sequence: Synthetic oligonucleotide
gaucaaagugugggauguu

SEQ ID NO: 185 - RNA, 19 nt, Artificial Sequence
  Description of Artificial Sequence: Synthetic oligonucleotide
aaagugugggaugugcugu

SEQ ID NO: 186 - RNA, 19 nt, Artificial Sequence
  Description of Artificial Sequence: Synthetic oligonucleotide
aagugccaucgugccgucu

SEQ ID NO: 187 - RNA, 19 nt, Artificial Sequence
  Description of Artificial Sequence: Synthetic oligonucleotide
uagcucagugccaucgugc

SEQ ID NO: 188 - RNA, 19 nt, Artificial Sequence
  Description of Artificial Sequence: Synthetic oligonucleotide
aagcucagugccaucgugc

SEQ ID NO: 189 - RNA, 19 nt, Artificial Sequence
  Description of Artificial Sequence: Synthetic oligonucleotide
uaucugggagcucagugcc

SEQ ID NO: 190 - RNA, 19 nt, Artificial Sequence
  Description of Artificial Sequence: Synthetic oligonucleotide
aaucugggagcucagugcc

SEQ ID NO: 191 - RNA, 19 nt, Artificial Sequence
  Description of Artificial Sequence: Synthetic oligonucleotide
uagaucugggagcucagug

SEQ ID NO: 192 - RNA, 19 nt, Artificial Sequence
  Description of Artificial Sequence: Synthetic oligonucleotide
aagaucugggagcucagug

SEQ ID NO: 193 - RNA, 19 nt, Artificial Sequence
  Description of Artificial Sequence: Synthetic oligonucleotide
aaacagagccacuggucag

SEQ ID NO: 194 - RNA, 19 nt, Artificial Sequence
  Description of Artificial Sequence: Synthetic oligonucleotide
uugugggaaaacagagcca

SEQ ID NO: 195 - RNA, 19 nt, Artificial Sequence
  Description of Artificial Sequence: Synthetic oligonucleotide
ugucuguugugggaaaaca

SEQ ID NO: 196 - RNA, 19 nt, Artificial Sequence
  Description of Artificial Sequence: Synthetic oligonucleotide
agucuguugugggaaaaca

SEQ ID NO: 197 - RNA, 19 nt, Artificial Sequence
  Description of Artificial Sequence: Synthetic oligonucleotide
aaguugucccgucuguugu

SEQ ID NO: 198 - RNA, 19 nt, Artificial Sequence
  Description of Artificial Sequence: Synthetic oligonucleotide
ucaaguugucccgucuguu

SEQ ID NO: 199 - RNA, 19 nt, Artificial Sequence
  Description of Artificial Sequence: Synthetic oligonucleotide
acaaguugucccgucuguu

SEQ ID NO: 200 - RNA, 19 nt, Artificial Sequence
  Description of Artificial Sequence: Synthetic oligonucleotide
ucugcaaguugucccgucu

SEQ ID NO: 201 - RNA, 19 nt, Artificial Sequence
  Description of Artificial Sequence: Synthetic oligonucleotide
uucugcaaguugucccguc

SEQ ID NO: 202 - RNA, 19 nt, Artificial Sequence
  Description of Artificial Sequence: Synthetic oligonucleotide
aucugcaaguugucccguc

SEQ ID NO: 203 - RNA, 19 nt, Artificial Sequence
  Description of Artificial Sequence: Synthetic oligonucleotide
ucucugcaaguugucccgu

SEQ ID NO: 204 - RNA, 19 nt, Artificial Sequence
  Description of Artificial Sequence: Synthetic oligonucleotide
acucugcaaguugucccgu

SEQ ID NO: 205 - RNA, 19 nt, Artificial Sequence
  Description of Artificial Sequence: Synthetic oligonucleotide
uaagugggugucucgccuc

SEQ ID NO: 206 - RNA, 19 nt, Artificial Sequence
  Description of Artificial Sequence: Synthetic oligonucleotide
aaagugggugucucgccuc

SEQ ID NO: 207 - RNA, 19 nt, Artificial Sequence
  Description of Artificial Sequence: Synthetic oligonucleotide
augcagauggggaaguggg

SEQ ID NO: 208 - RNA, 19 nt, Artificial Sequence
  Description of Artificial Sequence: Synthetic oligonucleotide
agaaaaugcagauggggaa

SEQ ID NO: 209 - RNA, 19 nt, Artificial Sequence
  Description of Artificial Sequence: Synthetic oligonucleotide
agcagaaaaugcagauggg

SEQ ID NO: 210 - RNA, 19 nt, Artificial Sequence
  Description of Artificial Sequence: Synthetic oligonucleotide
augacagcagccgcagcag

SEQ ID NO: 211 - RNA, 19 nt, Artificial Sequence
  Description of Artificial Sequence: Synthetic oligonucleotide
uaugacagcagccgcagca

SEQ ID NO: 212 - RNA, 19 nt, Artificial Sequence
  Description of Artificial Sequence: Synthetic oligonucleotide
aaugacagcagccgcagca

SEQ ID NO: 213 - RNA, 19 nt, Artificial Sequence
  Description of Artificial Sequence: Synthetic oligonucleotide
ucgaugacagcagccgcag

SEQ ID NO: 214 - RNA, 19 nt, Artificial Sequence
  Description of Artificial Sequence: Synthetic oligonucleotide
aucgaugacagcagccgca

SEQ ID NO: 215 - RNA, 19 nt, Artificial Sequence
  Description of Artificial Sequence: Synthetic oligonucleotide
uaucgaugacagcagccgc

SEQ ID NO: 216 - RNA, 19 nt, Artificial Sequence
  Description of Artificial Sequence: Synthetic oligonucleotide
aaucgaugacagcagccgc

SEQ ID NO: 217 - RNA, 19 nt, Artificial Sequence
  Description of Artificial Sequence: Synthetic oligonucleotide
ugaucgaugacagcagccg

SEQ ID NO: 218 - RNA, 19 nt, Artificial Sequence
  Description of Artificial Sequence: Synthetic oligonucleotide
uugaucgaugacagcagcc

SEQ ID NO: 219 - RNA, 19 nt, Artificial Sequence
  Description of Artificial Sequence: Synthetic oligonucleotide
uuugaucgaugacagcagc

SEQ ID NO: 220 - RNA, 19 nt, Artificial Sequence
  Description of Artificial Sequence: Synthetic oligonucleotide
uuuugaucgaugacagcag

SEQ ID NO: 221 - RNA, 19 nt, Artificial Sequence
  Description of Artificial Sequence: Synthetic oligonucleotide
auuugaucgaugacagcag

SEQ ID NO: 222 - RNA, 19 nt, Artificial Sequence
  Description of Artificial Sequence: Synthetic oligonucleotide
acuuugaucgaugacagca

SEQ ID NO: 223 - RNA, 19 nt, Artificial Sequence
  Description of Artificial Sequence: Synthetic oligonucleotide
uacuuugaucgaugacagc

SEQ ID NO: 224 - RNA, 19 nt, Artificial Sequence
  Description of Artificial Sequence: Synthetic oligonucleotide
aacuuugaucgaugacagc

SEQ ID NO: 225 - RNA, 19 nt, Artificial Sequence
  Description of Artificial Sequence: Synthetic oligonucleotide
acacuuugaucgaugacag

SEQ ID NO: 226 - RNA, 19 nt, Artificial Sequence
  Description of Artificial Sequence: Synthetic oligonucleotide
uacacuuugaucgaugaca

SEQ ID NO: 227 - RNA, 19 nt, Artificial Sequence
  Description of Artificial Sequence: Synthetic oligonucleotide
aacacuuugaucgaugaca

SEQ ID NO: 228 - RNA, 19 nt, Artificial Sequence
  Description of Artificial Sequence: Synthetic oligonucleotide
uccacacuuugaucgauga

SEQ ID NO: 229 - RNA, 19 nt, Artificial Sequence
  Description of Artificial Sequence: Synthetic oligonucleotide
accacacuuugaucgauga

SEQ ID NO: 230 - RNA, 19 nt, Artificial Sequence
  Description of Artificial Sequence: Synthetic oligonucleotide
uacaucccacacuuugauc

SEQ ID NO: 231 - RNA, 19 nt, Artificial Sequence
  Description of Artificial Sequence: Synthetic oligonucleotide
aacaucccacacuuugauc

SEQ ID NO: 232 - RNA, 19 nt, Artificial Sequence
  Description of Artificial Sequence: Synthetic oligonucleotide
acagcacaucccacacuuu

SEQ ID NO: 233 - DNA, 21 bp, Artificial Sequence
  Description of Artificial Sequence: Synthetic oligonucleotide
  Description of Combined DNA/RNA Molecule: Synthetic oligonucleotide
acugucacucggucccagatt

SEQ ID NO: 234 - DNA, 21 bp, Artificial Sequence
  Description of Artificial Sequence: Synthetic oligonucleotide
  Description of Combined DNA/RNA Molecule: Synthetic oligonucleotide
cacucggucccagacaccatt

SEQ ID NO: 235 - DNA, 21 bp, Artificial Sequence
  Description of Artificial Sequence: Synthetic oligonucleotide
  Description of Combined DNA/RNA Molecule: Synthetic oligonucleotide
ccagacaccagagcaagcutt

SEQ ID NO: 236 - DNA, 21 bp, Artificial Sequence
  Description of Artificial Sequence: Synthetic oligonucleotide
  Description of Combined DNA/RNA Molecule: Synthetic oligonucleotide
agcagugggacagccagactt

SEQ ID NO: 237 - DNA, 21 bp, Artificial Sequence
  Description of Artificial Sequence: Synthetic oligonucleotide
  Description of Combined DNA/RNA Molecule: Synthetic oligonucleotide
agcagugggacagccagaatt

SEQ ID NO: 238 - DNA, 21 bp, Artificial Sequence
  Description of Artificial Sequence: Synthetic oligonucleotide
  Description of Combined DNA/RNA Molecule: Synthetic oligonucleotide
agcagugggacagccagautt

SEQ ID NO: 239 - DNA, 21 bp, Artificial Sequence
  Description of Artificial Sequence: Synthetic oligonucleotide
  Description of Combined DNA/RNA Molecule: Synthetic oligonucleotide
ugggacagccagacagacgtt

SEQ ID NO: 240 - DNA, 21 bp, Artificial Sequence
  Description of Artificial Sequence: Synthetic oligonucleotide
  Description of Combined DNA/RNA Molecule: Synthetic oligonucleotide
ugggacagccagacagacutt

SEQ ID NO: 241 - DNA, 21 bp, Artificial Sequence
  Description of Artificial Sequence: Synthetic oligonucleotide
  Description of Combined DNA/RNA Molecule: Synthetic oligonucleotide
ugggacagccagacagacatt

SEQ ID NO: 242 - DNA, 21 bp, Artificial Sequence
  Description of Artificial Sequence: Synthetic oligonucleotide
  Description of Combined DNA/RNA Molecule: Synthetic oligonucleotide
gacagccagacagacggcatt

SEQ ID NO: 243 - DNA, 21 bp, Artificial Sequence
  Description of Artificial Sequence: Synthetic oligonucleotide
  Description of Combined DNA/RNA Molecule: Synthetic oligonucleotide
agccagacagacggcacgatt

SEQ ID NO: 244 - DNA, 21 bp, Artificial Sequence
  Description of Artificial Sequence: Synthetic oligonucleotide
  Description of Combined DNA/RNA Molecule: Synthetic oligonucleotide
gccagacagacggcacgautt

SEQ ID NO: 245 - DNA, 21 bp, Artificial Sequence
  Description of Artificial Sequence: Synthetic oligonucleotide
  Description of Combined DNA/RNA Molecule: Synthetic oligonucleotide
gacagacggcacgauggcatt

SEQ ID NO: 246 - DNA, 21 bp, Artificial Sequence
  Description of Artificial Sequence: Synthetic oligonucleotide
  Description of Combined DNA/RNA Molecule: Synthetic oligonucleotide
acagacggcacgauggcactt

SEQ ID NO: 247 - DNA, 21 bp, Artificial Sequence
  Description of Artificial Sequence: Synthetic oligonucleotide
  Description of Combined DNA/RNA Molecule: Synthetic oligonucleotide
acagacggcacgauggcaatt

SEQ ID NO: 248 - DNA, 21 bp, Artificial Sequence
  Description of Artificial Sequence: Synthetic oligonucleotide
  Description of Combined DNA/RNA Molecule: Synthetic oligonucleotide
acagacggcacgauggcautt

SEQ ID NO: 249 - DNA, 21 bp, Artificial Sequence
  Description of Artificial Sequence: Synthetic oligonucleotide
  Description of Combined DNA/RNA Molecule: Synthetic oligonucleotide
cagacggcacgauggcacutt

SEQ ID NO: 250 - DNA, 21 bp, Artificial Sequence
  Description of Artificial Sequence: Synthetic oligonucleotide
  Description of Combined DNA/RNA Molecule: Synthetic oligonucleotide
agacggcacgauggcacuutt

SEQ ID NO: 251 - DNA, 21 bp, Artificial Sequence
  Description of Artificial Sequence: Synthetic oligonucleotide
  Description of Combined DNA/RNA Molecule: Synthetic oligonucleotide
agacggcacgauggcacugtt

SEQ ID NO: 252 - DNA, 21 bp, Artificial Sequence
  Description of Artificial Sequence: Synthetic oligonucleotide
  Description of Combined DNA/RNA Molecule: Synthetic oligonucleotide
agacggcacgauggcacuatt

SEQ ID NO: 253 - DNA, 21 bp, Artificial Sequence
  Description of Artificial Sequence: Synthetic oligonucleotide
  Description of Combined DNA/RNA Molecule: Synthetic oligonucleotide
gacggcacgauggcacugatt

SEQ ID NO: 254 - DNA, 21 bp, Artificial Sequence
  Description of Artificial Sequence: Synthetic oligonucleotide
  Description of Combined DNA/RNA Molecule: Synthetic oligonucleotide
acggcacgauggcacugagtt

SEQ ID NO: 255 - DNA, 21 bp, Artificial Sequence
  Description of Artificial Sequence: Synthetic oligonucleotide
  Description of Combined DNA/RNA Molecule: Synthetic oligonucleotide
acggcacgauggcacugautt

SEQ ID NO: 256 - DNA, 21 bp, Artificial Sequence
  Description of Artificial Sequence: Synthetic oligonucleotide
  Description of Combined DNA/RNA Molecule: Synthetic oligonucleotide
acggcacgauggcacugaatt

SEQ ID NO: 257 - DNA, 21 bp, Artificial Sequence
  Description of Artificial Sequence: Synthetic oligonucleotide
  Description of Combined DNA/RNA Molecule: Synthetic oligonucleotide
ggcacgauggcacugagcutt

SEQ ID NO: 258 - DNA, 21 bp, Artificial Sequence
  Description of Artificial Sequence: Synthetic oligonucleotide
  Description of Combined DNA/RNA Molecule: Synthetic oligonucleotide
gcacgauggcacugagcuutt

SEQ ID NO: 259 - DNA, 21 bp, Artificial Sequence
  Description of Artificial Sequence: Synthetic oligonucleotide
  Description of Combined DNA/RNA Molecule: Synthetic oligonucleotide
gcacgauggcacugagcuatt

SEQ ID NO: 260 - DNA, 21 bp, Artificial Sequence
  Description of Artificial Sequence: Synthetic oligonucleotide
  Description of Combined DNA/RNA Molecule: Synthetic oligonucleotide
gcacgauggcacugagcuctt

SEQ ID NO: 261 - DNA, 21 bp, Artificial Sequence
  Description of Artificial Sequence: Synthetic oligonucleotide
  Description of Combined DNA/RNA Molecule: Synthetic oligonucleotide
cacgauggcacugagcucatt

SEQ ID NO: 262 - DNA, 21 bp, Artificial Sequence
  Description of Artificial Sequence: Synthetic oligonucleotide
  Description of Combined DNA/RNA Molecule: Synthetic oligonucleotide
cacgauggcacugagcucutt

SEQ ID NO: 263 - DNA, 21 bp, Artificial Sequence
  Description of Artificial Sequence: Synthetic oligonucleotide
  Description of Combined DNA/RNA Molecule: Synthetic oligonucleotide
cacgauggcacugagcucctt

SEQ ID NO: 264 - DNA, 21 bp, Artificial Sequence
  Description of Artificial Sequence: Synthetic oligonucleotide
  Description of Combined DNA/RNA Molecule: Synthetic oligonucleotide
acgauggcacugagcuccatt

SEQ ID NO: 265 - DNA, 21 bp, Artificial Sequence
  Description of Artificial Sequence: Synthetic oligonucleotide
  Description of Combined DNA/RNA Molecule: Synthetic oligonucleotide
acgauggcacugagcuccutt

SEQ ID NO: 266 - DNA, 21 bp, Artificial Sequence
  Description of Artificial Sequence: Synthetic oligonucleotide
  Description of Combined DNA/RNA Molecule: Synthetic oligonucleotide
acgauggcacugagcuccctt

SEQ ID NO: 267 - DNA, 21 bp, Artificial Sequence
  Description of Artificial Sequence: Synthetic oligonucleotide
  Description of Combined DNA/RNA Molecule: Synthetic oligonucleotide
cgauggcacugagcucccatt

SEQ ID NO: 268 - DNA, 21 bp, Artificial Sequence
  Description of Artificial Sequence: Synthetic oligonucleotide
  Description of Combined DNA/RNA Molecule: Synthetic oligonucleotide
gauggcacugagcucccagtt

SEQ ID NO: 269 - DNA, 21 bp, Artificial Sequence
  Description of Artificial Sequence: Synthetic oligonucleotide
  Description of Combined DNA/RNA Molecule: Synthetic oligonucleotide
auggcacugagcucccagatt

SEQ ID NO: 270 - DNA, 21 bp, Artificial Sequence
  Description of Artificial Sequence: Synthetic oligonucleotide
  Description of Combined DNA/RNA Molecule: Synthetic oligonucleotide
uggcacugagcucccagautt

SEQ ID NO: 271 - DNA, 21 bp, Artificial Sequence
  Description of Artificial Sequence: Synthetic oligonucleotide
  Description of Combined DNA/RNA Molecule: Synthetic oligonucleotide
ggcacugagcucccagauutt

SEQ ID NO: 272 - DNA, 21 bp, Artificial Sequence
  Description of Artificial Sequence: Synthetic oligonucleotide
  Description of Combined DNA/RNA Molecule: Synthetic oligonucleotide
ggcacugagcucccagauatt

SEQ ID NO: 273 - DNA, 21 bp, Artificial Sequence
  Description of Artificial Sequence: Synthetic oligonucleotide
  Description of Combined DNA/RNA Molecule: Synthetic oligonucleotide
ggcacugagcucccagauctt

SEQ ID NO: 274 - DNA, 21 bp, Artificial Sequence
  Description of Artificial Sequence: Synthetic oligonucleotide
  Description of Combined DNA/RNA Molecule: Synthetic oligonucleotide
gcacugagcucccagaucutt

SEQ ID NO: 275 - DNA, 21 bp, Artificial Sequence
  Description of Artificial Sequence: Synthetic oligonucleotide
  Description of Combined DNA/RNA Molecule: Synthetic oligonucleotide
cacugagcucccagaucuutt

SEQ ID NO: 276 - DNA, 21 bp, Artificial Sequence
  Description of Artificial Sequence: Synthetic oligonucleotide
  Description of Combined DNA/RNA Molecule: Synthetic oligonucleotide
cacugagcucccagaucuatt

SEQ ID NO: 277 - DNA, 21 bp, Artificial Sequence
  Description of Artificial Sequence: Synthetic oligonucleotide
  Description of Combined DNA/RNA Molecule: Synthetic oligonucleotide
cacugagcucccagaucugtt

SEQ ID NO: 278 - DNA, 21 bp, Artificial Sequence
  Description of Artificial Sequence: Synthetic oligonucleotide
  Description of Combined DNA/RNA Molecule: Synthetic oligonucleotide
agaucugggccgcuugccutt

SEQ ID NO: 279 - DNA, 21 bp, Artificial Sequence
  Description of Artificial Sequence: Synthetic oligonucleotide
  Description of Combined DNA/RNA Molecule: Synthetic oligonucleotide
ucugggccgcuugccuccutt

SEQ ID NO: 280 - DNA, 21 bp, Artificial Sequence
  Description of Artificial Sequence: Synthetic oligonucleotide
  Description of Combined DNA/RNA Molecule: Synthetic oligonucleotide
ccuccuccucgccagccugtt

SEQ ID NO: 281 - DNA, 21 bp, Artificial Sequence
  Description of Artificial Sequence: Synthetic oligonucleotide
  Description of Combined DNA/RNA Molecule: Synthetic oligonucleotide
cuccuccucgccagccugatt

SEQ ID NO: 282 - DNA, 21 bp, Artificial Sequence
  Description of Artificial Sequence: Synthetic oligonucleotide
  Description of Combined DNA/RNA Molecule: Synthetic oligonucleotide
uccuccucgccagccugactt

SEQ ID NO: 283 - DNA, 21 bp, Artificial Sequence
  Description of Artificial Sequence: Synthetic oligonucleotide
  Description of Combined DNA/RNA Molecule: Synthetic oligonucleotide
cuccucgccagccugaccatt

SEQ ID NO: 284 - DNA, 21 bp, Artificial Sequence
  Description of Artificial Sequence: Synthetic oligonucleotide
  Description of Combined DNA/RNA Molecule: Synthetic oligonucleotide
uccucgccagccugaccagtt

SEQ ID NO: 285 - DNA, 21 bp, Artificial Sequence
  Description of Artificial Sequence: Synthetic oligonucleotide
  Description of Combined DNA/RNA Molecule: Synthetic oligonucleotide
ccucgccagccugaccagutt

SEQ ID NO: 286 - DNA, 21 bp, Artificial Sequence
  Description of Artificial Sequence: Synthetic oligonucleotide
  Description of Combined DNA/RNA Molecule: Synthetic oligonucleotide
cucgccagccugaccagugtt

SEQ ID NO: 287 - DNA, 21 bp, Artificial Sequence
  Description of Artificial Sequence: Synthetic oligonucleotide
  Description of Combined DNA/RNA Molecule: Synthetic oligonucleotide
gccagccugaccaguggcutt

SEQ ID NO: 288 - DNA, 21 bp, Artificial Sequence
  Description of Artificial Sequence: Synthetic oligonucleotide
  Description of Combined DNA/RNA Molecule: Synthetic oligonucleotide
cugaccaguggcucuguuutt

SEQ ID NO: 289 - DNA, 21 bp, Artificial Sequence
  Description of Artificial Sequence: Synthetic oligonucleotide
  Description of Combined DNA/RNA Molecule: Synthetic oligonucleotide
uggcucuguuuucccacaatt

SEQ ID NO: 290 - DNA, 21 bp, Artificial Sequence
  Description of Artificial Sequence: Synthetic oligonucleotide
  Description of Combined DNA/RNA Molecule: Synthetic oligonucleotide
gcucuguuuucccacaacatt

SEQ ID NO: 291 - DNA, 21 bp, Artificial Sequence
  Description of Artificial Sequence: Synthetic oligonucleotide
  Description of Combined DNA/RNA Molecule: Synthetic oligonucleotide
uguuuucccacaacagacatt

SEQ ID NO: 292 - DNA, 21 bp, Artificial Sequence
  Description of Artificial Sequence: Synthetic oligonucleotide
  Description of Combined DNA/RNA Molecule: Synthetic oligonucleotide
uguuuucccacaacagacutt

SEQ ID NO: 293 - DNA, 21 bp, Artificial Sequence
  Description of Artificial Sequence: Synthetic oligonucleotide
  Description of Combined DNA/RNA Molecule: Synthetic oligonucleotide
uguuuucccacaacagacgtt

SEQ ID NO: 294 - DNA, 21 bp, Artificial Sequence
  Description of Artificial Sequence: Synthetic oligonucleotide
  Description of Combined DNA/RNA Molecule: Synthetic oligonucleotide
uuucccacaacagacgggatt

SEQ ID NO: 295 - DNA, 21 bp, Artificial Sequence
  Description of Artificial Sequence: Synthetic oligonucleotide
  Description of Combined DNA/RNA Molecule: Synthetic oligonucleotide
uucccacaacagacgggactt

SEQ ID NO: 296 - DNA, 21 bp, Artificial Sequence
  Description of Artificial Sequence: Synthetic oligonucleotide
  Description of Combined DNA/RNA Molecule: Synthetic oligonucleotide
ucccacaacagacgggacatt

SEQ ID NO: 297 - DNA, 21 bp, Artificial Sequence
  Description of Artificial Sequence: Synthetic oligonucleotide
  Description of Combined DNA/RNA Molecule: Synthetic oligonucleotide
cccacaacagacgggacaatt

SEQ ID NO: 298 - DNA, 21 bp, Artificial Sequence
  Description of Artificial Sequence: Synthetic oligonucleotide
  Description of Combined DNA/RNA Molecule: Synthetic oligonucleotide
ccacaacagacgggacaactt

SEQ ID NO: 299 - DNA, 21 bp, Artificial Sequence
  Description of Artificial Sequence: Synthetic oligonucleotide
  Description of Combined DNA/RNA Molecule: Synthetic oligonucleotide
ccacaacagacgggacaautt

SEQ ID NO: 300 - DNA, 21 bp, Artificial Sequence
  Description of Artificial Sequence: Synthetic oligonucleotide
  Description of Combined DNA/RNA Molecule: Synthetic oligonucleotide
ccacaacagacgggacaaatt

SEQ ID NO: 301 - DNA, 21 bp, Artificial Sequence
  Description of Artificial Sequence: Synthetic oligonucleotide
  Description of Combined DNA/RNA Molecule: Synthetic oligonucleotide
cacaacagacgggacaacutt

SEQ ID NO: 302 - DNA, 21 bp, Artificial Sequence
  Description of Artificial Sequence: Synthetic oligonucleotide
  Description of Combined DNA/RNA Molecule: Synthetic oligonucleotide
acaacagacgggacaacuutt

SEQ ID NO: 303 - DNA, 21 bp, Artificial Sequence
  Description of Artificial Sequence: Synthetic oligonucleotide
  Description of Combined DNA/RNA Molecule: Synthetic oligonucleotide
aacagacgggacaacuugutt

SEQ ID NO: 304 - DNA, 21 bp, Artificial Sequence
  Description of Artificial Sequence: Synthetic oligonucleotide
  Description of Combined DNA/RNA Molecule: Synthetic oligonucleotide
aacagacgggacaacuugatt

SEQ ID NO: 305 - DNA, 21 bp, Artificial Sequence
  Description of Artificial Sequence: Synthetic oligonucleotide
  Description of Combined DNA/RNA Molecule: Synthetic oligonucleotide
aacagacgggacaacuugctt

SEQ ID NO: 306 - DNA, 21 bp, Artificial Sequence
  Description of Artificial Sequence: Synthetic oligonucleotide
  Description of Combined DNA/RNA Molecule: Synthetic oligonucleotide
cagacgggacaacuugcagtt

SEQ ID NO: 307 - DNA, 21 bp, Artificial Sequence
  Description of Artificial Sequence: Synthetic oligonucleotide
  Description of Combined DNA/RNA Molecule: Synthetic oligonucleotide
agacgggacaacuugcagatt

SEQ ID NO: 308 - DNA, 21 bp, Artificial Sequence
  Description of Artificial Sequence: Synthetic oligonucleotide
  Description of Combined DNA/RNA Molecule: Synthetic oligonucleotide
gacgggacaacuugcagautt

SEQ ID NO: 309 - DNA, 21 bp, Artificial Sequence
  Description of Artificial Sequence: Synthetic oligonucleotide
  Description of Combined DNA/RNA Molecule: Synthetic oligonucleotide
gacgggacaacuugcagaatt

SEQ ID NO: 310 - DNA, 21 bp, Artificial Sequence
  Description of Artificial Sequence: Synthetic oligonucleotide
  Description of Combined DNA/RNA Molecule: Synthetic oligonucleotide
gacgggacaacuugcagagtt

SEQ ID NO: 311 - DNA, 21 bp, Artificial Sequence
  Description of Artificial Sequence: Synthetic oligonucleotide
  Description of Combined DNA/RNA Molecule: Synthetic oligonucleotide
acgggacaacuugcagagatt

SEQ ID NO: 312 - DNA, 21 bp, Artificial Sequence
  Description of Artificial Sequence: Synthetic oligonucleotide
  Description of Combined DNA/RNA Molecule: Synthetic oligonucleotide
acgggacaacuugcagagutt

SEQ ID NO: 313 - DNA, 21 bp, Artificial Sequence
  Description of Artificial Sequence: Synthetic oligonucleotide
  Description of Combined DNA/RNA Molecule: Synthetic oligonucleotide
acgggacaacuugcagagctt

SEQ ID NO: 314 - DNA, 21 bp, Artificial Sequence
  Description of Artificial Sequence: Synthetic oligonucleotide
  Description of Combined DNA/RNA Molecule: Synthetic oligonucleotide
cgggacaacuugcagagcutt

SEQ ID NO: 315 - DNA, 21 bp, Artificial Sequence
  Description of Artificial Sequence: Synthetic oligonucleotide
  Description of Combined DNA/RNA Molecule: Synthetic oligonucleotide
gggacaacuugcagagcugtt

SEQ ID NO: 316 - DNA, 21 bp, Artificial Sequence
  Description of Artificial Sequence: Synthetic oligonucleotide
  Description of Combined DNA/RNA Molecule: Synthetic oligonucleotide
ggacaacuugcagagcugctt

SEQ ID NO: 317 - DNA, 21 bp, Artificial Sequence
  Description of Artificial Sequence: Synthetic oligonucleotide
  Description of Combined DNA/RNA Molecule: Synthetic oligonucleotide
ggacaacuugcagagcugatt

SEQ ID NO: 318 - DNA, 21 bp, Artificial Sequence
  Description of Artificial Sequence: Synthetic oligonucleotide
  Description of Combined DNA/RNA Molecule: Synthetic oligonucleotide
ggacaacuugcagagcugutt

SEQ ID NO: 319 - DNA, 21 bp, Artificial Sequence
  Description of Artificial Sequence: Synthetic oligonucleotide
  Description of Combined DNA/RNA Molecule: Synthetic oligonucleotide
gacaacuugcagagcugcatt

SEQ ID NO: 320 - DNA, 21 bp, Artificial Sequence
  Description of Artificial Sequence: Synthetic oligonucleotide
  Description of Combined DNA/RNA Molecule: Synthetic oligonucleotide
acaacuugcagagcugcaatt

SEQ ID NO: 321 - DNA, 21 bp, Artificial Sequence
  Description of Artificial Sequence: Synthetic oligonucleotide
  Description of Combined DNA/RNA Molecule: Synthetic oligonucleotide
caacuugcagagcugcaactt

SEQ ID NO: 322 - DNA, 21 bp, Artificial Sequence
  Description of Artificial Sequence: Synthetic oligonucleotide
  Description of Combined DNA/RNA Molecule: Synthetic oligonucleotide
aacuugcagagcugcaacutt

SEQ ID NO: 323 - DNA, 21 bp, Artificial Sequence
  Description of Artificial Sequence: Synthetic oligonucleotide
  Description of Combined DNA/RNA Molecule: Synthetic oligonucleotide
aacuugcagagcugcaacatt

SEQ ID NO: 324 - DNA, 21 bp, Artificial Sequence
  Description of Artificial Sequence: Synthetic oligonucleotide
  Description of Combined DNA/RNA Molecule: Synthetic oligonucleotide
aacuugcagagcugcaacctt

SEQ ID NO: 325 - DNA, 21 bp, Artificial Sequence
  Description of Artificial Sequence: Synthetic oligonucleotide
  Description of Combined DNA/RNA Molecule: Synthetic oligonucleotide
acuugcagagcugcaaccutt

SEQ ID NO: 326 - DNA, 21 bp, Artificial Sequence
  Description of Artificial Sequence: Synthetic oligonucleotide
  Description of Combined DNA/RNA Molecule: Synthetic oligonucleotide
acuugcagagcugcaaccatt

SEQ ID NO: 327 - DNA, 21 bp, Artificial Sequence
  Description of Artificial Sequence: Synthetic oligonucleotide
  Description of Combined DNA/RNA Molecule: Synthetic oligonucleotide
acuugcagagcugcaaccctt

SEQ ID NO: 328 - DNA, 21 bp, Artificial Sequence
  Description of Artificial Sequence: Synthetic oligonucleotide
  Description of Combined DNA/RNA Molecule: Synthetic oligonucleotide
caggacagagcuggagccatt

SEQ ID NO: 329 - DNA, 21 bp, Artificial Sequence
  Description of Artificial Sequence: Synthetic oligonucleotide
  Description of Combined DNA/RNA Molecule: Synthetic oligonucleotide
aggacagagcuggagccagtt

SEQ ID NO: 330 - DNA, 21 bp, Artificial Sequence
  Description of Artificial Sequence: Synthetic oligonucleotide
  Description of Combined DNA/RNA Molecule: Synthetic oligonucleotide
cuggagccagggccagcugtt

SEQ ID NO: 331 - DNA, 21 bp, Artificial Sequence
  Description of Artificial Sequence: Synthetic oligonucleotide
  Description of Combined DNA/RNA Molecule: Synthetic oligonucleotide
cccauguuccagaggcgaatt

SEQ ID NO: 332 - DNA, 21 bp, Artificial Sequence
  Description of Artificial Sequence: Synthetic oligonucleotide
  Description of Combined DNA/RNA Molecule: Synthetic oligonucleotide
uuccagaggcgaaggaggutt

SEQ ID NO: 333 - DNA, 21 bp, Artificial Sequence
  Description of Artificial Sequence: Synthetic oligonucleotide
  Description of Combined DNA/RNA Molecule: Synthetic oligonucleotide
uuccagaggcgaaggaggatt

SEQ ID NO: 334 - DNA, 21 bp, Artificial Sequence
  Description of Artificial Sequence: Synthetic oligonucleotide
  Description of Combined DNA/RNA Molecule: Synthetic oligonucleotide
uuccagaggcgaaggaggctt

SEQ ID NO: 335 - DNA, 21 bp, Artificial Sequence
  Description of Artificial Sequence: Synthetic oligonucleotide
  Description of Combined DNA/RNA Molecule: Synthetic oligonucleotide
ccagaggcgaaggaggcgatt

SEQ ID NO: 336 - DNA, 21 bp, Artificial Sequence
  Description of Artificial Sequence: Synthetic oligonucleotide
  Description of Combined DNA/RNA Molecule: Synthetic oligonucleotide
cagaggcgaaggaggcgagtt

SEQ ID NO: 337 - DNA, 21 bp, Artificial Sequence
  Description of Artificial Sequence: Synthetic oligonucleotide
  Description of Combined DNA/RNA Molecule: Synthetic oligonucleotide
agaggcgaaggaggcgagatt

SEQ ID NO: 338 - DNA, 21 bp, Artificial Sequence
  Description of Artificial Sequence: Synthetic oligonucleotide
  Description of Combined DNA/RNA Molecule: Synthetic oligonucleotide
gaggcgaaggaggcgagactt

SEQ ID NO: 339 - DNA, 21 bp, Artificial Sequence
  Description of Artificial Sequence: Synthetic oligonucleotide
  Description of Combined DNA/RNA Molecule: Synthetic oligonucleotide
aggcgaaggaggcgagacatt

SEQ ID NO: 340 - DNA, 21 bp, Artificial Sequence
  Description of Artificial Sequence: Synthetic oligonucleotide
  Description of Combined DNA/RNA Molecule: Synthetic oligonucleotide
ggcgaaggaggcgagacactt

SEQ ID NO: 341 - DNA, 21 bp, Artificial Sequence
  Description of Artificial Sequence: Synthetic oligonucleotide
  Description of Combined DNA/RNA Molecule: Synthetic oligonucleotide
aaggaggcgagacacccaatt

SEQ ID NO: 342 - DNA, 21 bp, Artificial Sequence
  Description of Artificial Sequence: Synthetic oligonucleotide
  Description of Combined DNA/RNA Molecule: Synthetic oligonucleotide
aaggaggcgagacacccautt

SEQ ID NO: 343 - DNA, 21 bp, Artificial Sequence
  Description of Artificial Sequence: Synthetic oligonucleotide
  Description of Combined DNA/RNA Molecule: Synthetic oligonucleotide
aaggaggcgagacacccactt

SEQ ID NO: 344 - DNA, 21 bp, Artificial Sequence
  Description of Artificial Sequence: Synthetic oligonucleotide
  Description of Combined DNA/RNA Molecule: Synthetic oligonucleotide
aggaggcgagacacccacutt

SEQ ID NO: 345 - DNA, 21 bp, Artificial Sequence
  Description of Artificial Sequence: Synthetic oligonucleotide
  Description of Combined DNA/RNA Molecule: Synthetic oligonucleotide
ggaggcgagacacccacuutt

SEQ ID NO: 346 - DNA, 21 bp, Artificial Sequence
  Description of Artificial Sequence: Synthetic oligonucleotide
  Description of Combined DNA/RNA Molecule: Synthetic oligonucleotide
gaggcgagacacccacuuutt

SEQ ID NO: 347 - DNA, 21 bp, Artificial Sequence
  Description of Artificial Sequence: Synthetic oligonucleotide
  Description of Combined DNA/RNA Molecule: Synthetic oligonucleotide
gaggcgagacacccacuuatt

SEQ ID NO: 348 - DNA, 21 bp, Artificial Sequence
  Description of Artificial Sequence: Synthetic oligonucleotide
  Description of Combined DNA/RNA Molecule: Synthetic oligonucleotide
gaggcgagacacccacuuctt

SEQ ID NO: 349 - DNA, 21 bp, Artificial Sequence
  Description of Artificial Sequence: Synthetic oligonucleotide
  Description of Combined DNA/RNA Molecule: Synthetic oligonucleotide
cgagacacccacuuccccatt

SEQ ID NO: 350 - DNA, 21 bp, Artificial Sequence
  Description of Artificial Sequence: Synthetic oligonucleotide
  Description of Combined DNA/RNA Molecule: Synthetic oligonucleotide
gagacacccacuuccccautt

SEQ ID NO: 351 - DNA, 21 bp, Artificial Sequence
  Description of Artificial Sequence: Synthetic oligonucleotide
  Description of Combined DNA/RNA Molecule: Synthetic oligonucleotide
agacacccacuuccccauctt

SEQ ID NO: 352 - DNA, 21 bp, Artificial Sequence
  Description of Artificial Sequence: Synthetic oligonucleotide
  Description of Combined DNA/RNA Molecule: Synthetic oligonucleotide
cacccacuuccccaucugctt

SEQ ID NO: 353 - DNA, 21 bp, Artificial Sequence
  Description of Artificial Sequence: Synthetic oligonucleotide
  Description of Combined DNA/RNA Molecule: Synthetic oligonucleotide
cacccacuuccccaucugatt

SEQ ID NO: 354 - DNA, 21 bp, Artificial Sequence
  Description of Artificial Sequence: Synthetic oligonucleotide
  Description of Combined DNA/RNA Molecule: Synthetic oligonucleotide
cacccacuuccccaucugutt

SEQ ID NO: 355 - DNA, 21 bp, Artificial Sequence
  Description of Artificial Sequence: Synthetic oligonucleotide
  Description of Combined DNA/RNA Molecule: Synthetic oligonucleotide
acccacuuccccaucugcatt

SEQ ID NO: 356 - DNA, 21 bp, Artificial Sequence
  Description of Artificial Sequence: Synthetic oligonucleotide
  Description of Combined DNA/RNA Molecule: Synthetic oligonucleotide
cccacuuccccaucugcautt

SEQ ID NO: 357 - DNA, 21 bp, Artificial Sequence
  Description of Artificial Sequence: Synthetic oligonucleotide
  Description of Combined DNA/RNA Molecule: Synthetic oligonucleotide
cacuuccccaucugcauuutt

SEQ ID NO: 358 - DNA, 21 bp, Artificial Sequence
  Description of Artificial Sequence: Synthetic oligonucleotide
  Description of Combined DNA/RNA Molecule: Synthetic oligonucleotide
acuuccccaucugcauuuutt

SEQ ID NO: 359 - DNA, 21 bp, Artificial Sequence
  Description of Artificial Sequence: Synthetic oligonucleotide
  Description of Combined DNA/RNA Molecule: Synthetic oligonucleotide
cuuccccaucugcauuuuctt

SEQ ID NO: 360 - DNA, 21 bp, Artificial Sequence
  Description of Artificial Sequence: Synthetic oligonucleotide
  Description of Combined DNA/RNA Molecule: Synthetic oligonucleotide
uuccccaucugcauuuucutt

SEQ ID NO: 361 - DNA, 21 bp, Artificial Sequence
  Description of Artificial Sequence: Synthetic oligonucleotide
  Description of Combined DNA/RNA Molecule: Synthetic oligonucleotide
cccaucugcauuuucugcutt

SEQ ID NO: 362 - DNA, 21 bp, Artificial Sequence
  Description of Artificial Sequence: Synthetic oligonucleotide
  Description of Combined DNA/RNA Molecule: Synthetic oligonucleotide
ccaucugcauuuucugcugtt

SEQ ID NO: 363 - DNA, 21 bp, Artificial Sequence
  Description of Artificial Sequence: Synthetic oligonucleotide
  Description of Combined DNA/RNA Molecule: Synthetic oligonucleotide
ugcauuuucugcugcggcutt

SEQ ID NO: 364 - DNA, 21 bp, Artificial Sequence
  Description of Artificial Sequence: Synthetic oligonucleotide
  Description of Combined DNA/RNA Molecule: Synthetic oligonucleotide
gcauuuucugcugcggcugtt

SEQ ID NO: 365 - DNA, 21 bp, Artificial Sequence
  Description of Artificial Sequence: Synthetic oligonucleotide
  Description of Combined DNA/RNA Molecule: Synthetic oligonucleotide
auuuucugcugcggcugcutt

SEQ ID NO: 366 - DNA, 21 bp, Artificial Sequence
  Description of Artificial Sequence: Synthetic oligonucleotide
  Description of Combined DNA/RNA Molecule: Synthetic oligonucleotide
uuuucugcugcggcugcugtt

SEQ ID NO: 367 - DNA, 21 bp, Artificial Sequence
  Description of Artificial Sequence: Synthetic oligonucleotide
  Description of Combined DNA/RNA Molecule: Synthetic oligonucleotide
uuucugcugcggcugcugutt

SEQ ID NO: 368 - DNA, 21 bp, Artificial Sequence
  Description of Artificial Sequence: Synthetic oligonucleotide
  Description of Combined DNA/RNA Molecule: Synthetic oligonucleotide
uucugcugcggcugcuguctt

SEQ ID NO: 369 - DNA, 21 bp, Artificial Sequence
  Description of Artificial Sequence: Synthetic oligonucleotide
  Description of Combined DNA/RNA Molecule: Synthetic oligonucleotide
ucugcugcggcugcugucatt

SEQ ID NO: 370 - DNA, 21 bp, Artificial Sequence
  Description of Artificial Sequence: Synthetic oligonucleotide
  Description of Combined DNA/RNA Molecule: Synthetic oligonucleotide
cugcugcggcugcugucautt

SEQ ID NO: 371 - DNA, 21 bp, Artificial Sequence
  Description of Artificial Sequence: Synthetic oligonucleotide
  Description of Combined DNA/RNA Molecule: Synthetic oligonucleotide
ugcugcggcugcugucauutt

SEQ ID NO: 372 - DNA, 21 bp, Artificial Sequence
  Description of Artificial Sequence: Synthetic oligonucleotide
  Description of Combined DNA/RNA Molecule: Synthetic oligonucleotide
ugcugcggcugcugucauatt

SEQ ID NO: 373 - DNA, 21 bp, Artificial Sequence
  Description of Artificial Sequence: Synthetic oligonucleotide
  Description of Combined DNA/RNA Molecule: Synthetic oligonucleotide
ugcugcggcugcugucauctt

SEQ ID NO: 374 - DNA, 21 bp, Artificial Sequence
  Description of Artificial Sequence: Synthetic oligonucleotide
  Description of Combined DNA/RNA Molecule: Synthetic oligonucleotide
cugcggcugcugucaucgatt

SEQ ID NO: 375 - DNA, 21 bp, Artificial Sequence
  Description of Artificial Sequence: Synthetic oligonucleotide
  Description of Combined DNA/RNA Molecule: Synthetic oligonucleotide
ugcggcugcugucaucgautt

SEQ ID NO: 376 - DNA, 21 bp, Artificial Sequence
  Description of Artificial Sequence: Synthetic oligonucleotide
  Description of Combined DNA/RNA Molecule: Synthetic oligonucleotide
gcggcugcugucaucgauutt

SEQ ID NO: 377 - DNA, 21 bp, Artificial Sequence
  Description of Artificial Sequence: Synthetic oligonucleotide
  Description of Combined DNA/RNA Molecule: Synthetic oligonucleotide
gcggcugcugucaucgauatt

SEQ ID NO: 378 - DNA, 21 bp, Artificial Sequence
  Description of Artificial Sequence: Synthetic oligonucleotide
  Description of Combined DNA/RNA Molecule: Synthetic oligonucleotide
cggcugcugucaucgaucatt

SEQ ID NO: 379 - DNA, 21 bp, Artificial Sequence
  Description of Artificial Sequence: Synthetic oligonucleotide
  Description of Combined DNA/RNA Molecule: Synthetic oligonucleotide
ggcugcugucaucgaucaatt

SEQ ID NO: 380 - DNA, 21 bp, Artificial Sequence
  Description of Artificial Sequence: Synthetic oligonucleotide
  Description of Combined DNA/RNA Molecule: Synthetic oligonucleotide
gcugcugucaucgaucaaatt

SEQ ID NO: 381 - DNA, 21 bp, Artificial Sequence
  Description of Artificial Sequence: Synthetic oligonucleotide
  Description of Combined DNA/RNA Molecule: Synthetic oligonucleotide
cugcugucaucgaucaaautt

SEQ ID NO: 382 - DNA, 21 bp, Artificial Sequence
  Description of Artificial Sequence: Synthetic oligonucleotide
  Description of Combined DNA/RNA Molecule: Synthetic oligonucleotide
cugcugucaucgaucaaaatt

SEQ ID NO: 383 - DNA, 21 bp, Artificial Sequence
  Description of Artificial Sequence: Synthetic oligonucleotide
  Description of Combined DNA/RNA Molecule: Synthetic oligonucleotide
cugcugucaucgaucaaagtt

SEQ ID NO: 384 - DNA, 21 bp, Artificial Sequence
  Description of Artificial Sequence: Synthetic oligonucleotide
  Description of Combined DNA/RNA Molecule: Synthetic oligonucleotide
ugcugucaucgaucaaagutt

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
gcugucaucgaucaaaguutt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
gcugucaucgaucaaaguatt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
gcugucaucgaucaaagugtt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
cugucaucgaucaaagugutt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
ugucaucgaucaaaguguutt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
ugucaucgaucaaaguguatt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
ugucaucgaucaaagugugtt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
ucaucgaucaaaguguggatt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
ucaucgaucaaaguguggutt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
ucaucgaucaaagugugggtt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
caucgaucaaagugugggatt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
aucgaucaaagugugggautt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
ucgaucaaagugugggaugtt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
cgaucaaagugugggaugutt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
gaucaaagugugggauguutt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
gaucaaagugugggauguatt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
gaucaaagugugggaugugtt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
aucaaagugugggaugugutt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
aucaaagugugggaugugatt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
aucaaagugugggaugugctt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
ucaaagugugggaugugcutt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
caaagugugggaugugcugtt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
aaagugugggaugugcugutt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
aaagugugggaugugcugatt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
aaagugugggaugugcugctt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
aagugugggaugugcugcatt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
agugugggaugugcugcaatt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
gggaugugcugcaagacgutt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
ggaugugcugcaagacguatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
augugcugcaagacguagatt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
ugugcugcaagacguagaatt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
gcugcaagacguagaaccutt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
cugcaagacguagaaccuatt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
cguagaaccuaccugcccutt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
guccccucccuuccuuauutt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
uccccucccuuccuuauuutt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
ccccucccuuccuuauuuatt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
cccucccuuccuuauuuautt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
ccucccuuccuuauuuauutt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
cucccuuccuuauuuauuutt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
cucccuuccuuauuuauuatt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
cccuuccuuauuuauuccutt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
ccuuccuuauuuauuccuatt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
ccuuccuuauuuauuccuutt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
cuuccuuauuuauuccugutt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
cuuccuuauuuauuccugatt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
uuccuuauuuauuccugcutt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
uccuuauuuauuccugcuutt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
uccuuauuuauuccugcuatt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
ccuuauuuauuccugcugutt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
ccuuauuuauuccugcugatt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
auuuauuccugcugccccatt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
uuauuccugcugccccagatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
uauuccugcugccccagaatt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
uccugcugccccagaacautt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
ccugcugccccagaacauatt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
gcugccccagaacauaggutt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
ugccccagaacauaggucutt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
gccccagaacauaggucuutt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
ccagaacauaggucuuggatt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
cagaacauaggucuuggaatt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
agaacauaggucuuggaautt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
gaacauagguctuggaatatt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
gaacacaggucuuggaauatt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
gaacauaggucuuggaauauu

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
aacauaggucuuggaauaatt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
cauaggucuuggaauaaaatt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
gaauaaaauggcugguucutt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
auaaaauggcugguucuuutt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
uaaaauggcugguucuuuutt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
aauggcugguucuuuuguutt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
auggcugguucuuuuguuutt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
cugguucuuuuguuuuccatt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
ucugggaccgagugacagutt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
uggugucugggaccgagugtt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
agcuugcucuggugucuggtt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
gucuggcugucccacugcutt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
uucuggcugucccacugcutt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
aucuggcugucccacugcutt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
cgucugucuggcugucccatt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
agucugucuggcugucccatt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
ugucugucuggcugucccatt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
ugccgucugucuggcuguctt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
ucgugccgucugucuggcutt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
aucgugccgucugucuggctt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
ugccaucgugccgucuguctt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
gugccaucgugccgucugutt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
uugccaucgugccgucugutt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
augccaucgugccgucugutt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
agugccaucgugccgucugtt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
aagugccaucgugccgucutt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
cagugccaucgugccgucutt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
uagugccaucgugccgucutt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
ucagugccaucgugccguctt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
cucagugccaucgugccgutt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
aucagugccaucgugccgutt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
uucagugccaucgugccgutt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
agcucagugccaucgugcctt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
aagcucagugccaucgugctt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
cagcucagugccaucgugctt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
gagcucagugccaucgugctt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
uagcucagugccaucgugctt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
ugagcucagugccaucgugtt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
agagcucagugccaucgugtt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ggagcucagugccaucgugtt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
uggagcucagugccaucgutt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
aggagcucagugccaucgutt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
gggagcucagugccaucgutt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
ugggagcucagugccaucgtt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
cugggagcucagugccauctt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
ucugggagcucagugccautt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
aucugggagcucagugccatt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
aaucugggagcucagugcctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
caucugggagcucagugcctt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
gaucugggagcucagugcctt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
uaucugggagcucagugcctt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
agaucugggagcucagugctt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
aagaucugggagcucagugtt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
cagaucugggagcucagugtt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
uagaucugggagcucagugtt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
aggcaagcggcccagaucutt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
aggaggcaagcggcccagatt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
caggcuggcgaggaggaggtt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
ucaggcuggcgaggaggagtt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
gucaggcuggcgaggaggatt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
uggucaggcuggcgaggagtt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
cuggucaggcuggcgaggatt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
acuggucaggcuggcgaggtt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
cacuggucaggcuggcgagtt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
agccacuggucaggcuggctt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
aaacagagccacuggucagtt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
uugugggaaaacagagccatt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
uguugugggaaaacagagctt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
ugucuguugugggaaaacatt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
agucuguugugggaaaacatt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
cgucuguugugggaaaacatt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
ucccgucuguugugggaaatt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
gucccgucuguugugggaatt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
ugucccgucuguugugggatt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
uugucccgucuguugugggtt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
guugucccgucuguuguggtt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
auugucccgucuguuguggtt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
uuugucccgucuguuguggtt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
aguugucccgucuguugugtt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
aaguugucccgucuguugutt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
acaaguugucccgucuguutt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
ucaaguugucccgucuguutt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
gcaaguugucccgucuguutt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
cugcaaguugucccgucugtt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
ucugcaaguugucccgucutt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
aucugcaaguugucccguctt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
uucugcaaguugucccguctt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
cucugcaaguugucccguctt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
ucucugcaaguugucccgutt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
acucugcaaguugucccgutt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
gcucugcaaguugucccgutt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
agcucugcaaguugucccgtt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
cagcucugcaaguuguccctt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
gcagcucugcaaguugucctt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
ucagcucugcaaguugucctt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
acagcucugcaaguugucctt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
ugcagcucugcaaguuguctt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
uugcagcucugcaaguugutt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
guugcagcucugcaaguugtt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
aguugcagcucugcaaguutt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
uguugcagcucugcaaguutt

SEQ ID NO: 551 - DNA, 21 bp, Artificial Sequence
  Description of Artificial Sequence: Synthetic oligonucleotide
  Description of Combined DNA/RNA Molecule: Synthetic oligonucleotide
gguugcagcucugcaaguutt

SEQ ID NO: 552 - DNA, 21 bp, Artificial Sequence
  Description of Artificial Sequence: Synthetic oligonucleotide
  Description of Combined DNA/RNA Molecule: Synthetic oligonucleotide
agguugcagcucugcaagutt

SEQ ID NO: 553 - DNA, 21 bp, Artificial Sequence
  Description of Artificial Sequence: Synthetic oligonucleotide
  Description of Combined DNA/RNA Molecule: Synthetic oligonucleotide
ugguugcagcucugcaagutt

SEQ ID NO: 554 - DNA, 21 bp, Artificial Sequence
  Description of Artificial Sequence: Synthetic oligonucleotide
  Description of Combined DNA/RNA Molecule: Synthetic oligonucleotide
ggguugcagcucugcaagutt

SEQ ID NO: 555 - DNA, 21 bp, Artificial Sequence
  Description of Artificial Sequence: Synthetic oligonucleotide
  Description of Combined DNA/RNA Molecule: Synthetic oligonucleotide
uggcuccagcucuguccugtt

SEQ ID NO: 556 - DNA, 21 bp, Artificial Sequence
  Description of Artificial Sequence: Synthetic oligonucleotide
  Description of Combined DNA/RNA Molecule: Synthetic oligonucleotide
cuggcuccagcucuguccutt

SEQ ID NO: 557 - DNA, 21 bp, Artificial Sequence
  Description of Artificial Sequence: Synthetic oligonucleotide
  Description of Combined DNA/RNA Molecule: Synthetic oligonucleotide
cagcuggcccuggcuccagtt

SEQ ID NO: 558 - DNA, 21 bp, Artificial Sequence
  Description of Artificial Sequence: Synthetic oligonucleotide
  Description of Combined DNA/RNA Molecule: Synthetic oligonucleotide
uucgccucuggaacaugggtt

SEQ ID NO: 559 - DNA, 21 bp, Artificial Sequence
  Description of Artificial Sequence: Synthetic oligonucleotide
  Description of Combined DNA/RNA Molecule: Synthetic oligonucleotide
accuccuucgccucuggaatt

SEQ ID NO: 560 - DNA, 21 bp, Artificial Sequence
  Description of Artificial Sequence: Synthetic oligonucleotide
  Description of Combined DNA/RNA Molecule: Synthetic oligonucleotide
uccuccuucgccucuggaatt

SEQ ID NO: 561 - DNA, 21 bp, Artificial Sequence
  Description of Artificial Sequence: Synthetic oligonucleotide
  Description of Combined DNA/RNA Molecule: Synthetic oligonucleotide
gccuccuucgccucuggaatt

SEQ ID NO: 562 - DNA, 21 bp, Artificial Sequence
  Description of Artificial Sequence: Synthetic oligonucleotide
  Description of Combined DNA/RNA Molecule: Synthetic oligonucleotide
ucgccuccuucgccucuggtt

SEQ ID NO: 563 - DNA, 21 bp, Artificial Sequence
  Description of Artificial Sequence: Synthetic oligonucleotide
  Description of Combined DNA/RNA Molecule: Synthetic oligonucleotide
cucgccuccuucgccucugtt

SEQ ID NO: 564 - DNA, 21 bp, Artificial Sequence
  Description of Artificial Sequence: Synthetic oligonucleotide
  Description of Combined DNA/RNA Molecule: Synthetic oligonucleotide
ucucgccuccuucgccucutt

SEQ ID NO: 565 - DNA, 21 bp, Artificial Sequence
  Description of Artificial Sequence: Synthetic oligonucleotide
  Description of Combined DNA/RNA Molecule: Synthetic oligonucleotide
gucucgccuccuucgccuctt

SEQ ID NO: 566 - DNA, 21 bp, Artificial Sequence
  Description of Artificial Sequence: Synthetic oligonucleotide
  Description of Combined DNA/RNA Molecule: Synthetic oligonucleotide
ugucucgccuccuucgccutt

SEQ ID NO: 567 - DNA, 21 bp, Artificial Sequence
  Description of Artificial Sequence: Synthetic oligonucleotide
  Description of Combined DNA/RNA Molecule: Synthetic oligonucleotide
gugucucgccuccuucgcctt

SEQ ID NO: 568 - DNA, 21 bp, Artificial Sequence
  Description of Artificial Sequence: Synthetic oligonucleotide
  Description of Combined DNA/RNA Molecule: Synthetic oligonucleotide
uugggugucucgccuccuutt

SEQ ID NO: 569 - DNA, 21 bp, Artificial Sequence
  Description of Artificial Sequence: Synthetic oligonucleotide
  Description of Combined DNA/RNA Molecule: Synthetic oligonucleotide
augggugucucgccuccuutt

SEQ ID NO: 570 - DNA, 21 bp, Artificial Sequence
  Description of Artificial Sequence: Synthetic oligonucleotide
  Description of Combined DNA/RNA Molecule: Synthetic oligonucleotide
gugggugucucgccuccuutt

SEQ ID NO: 571 - DNA, 21 bp, Artificial Sequence
  Description of Artificial Sequence: Synthetic oligonucleotide
  Description of Combined DNA/RNA Molecule: Synthetic oligonucleotide
agugggugucucgccuccutt

SEQ ID NO: 572 - DNA, 21 bp, Artificial Sequence
  Description of Artificial Sequence: Synthetic oligonucleotide
  Description of Combined DNA/RNA Molecule: Synthetic oligonucleotide
aagugggugucucgccucctt

SEQ ID NO: 573 - DNA, 21 bp, Artificial Sequence
  Description of Artificial Sequence: Synthetic oligonucleotide
  Description of Combined DNA/RNA Molecule: Synthetic oligonucleotide
aaagugggugucucgccuctt

SEQ ID NO: 574 - DNA, 21 bp, Artificial Sequence
  Description of Artificial Sequence: Synthetic oligonucleotide
  Description of Combined DNA/RNA Molecule: Synthetic oligonucleotide
caagugggugucucgccuctt

SEQ ID NO: 575 - DNA, 21 bp, Artificial Sequence
  Description of Artificial Sequence: Synthetic oligonucleotide
  Description of Combined DNA/RNA Molecule: Synthetic oligonucleotide
gaagugggugucucgccuctt

SEQ ID NO: 576 - DNA, 21 bp, Artificial Sequence
  Description of Artificial Sequence: Synthetic oligonucleotide
  Description of Combined DNA/RNA Molecule: Synthetic oligonucleotide
uaagugggugucucgccuctt

SEQ ID NO: 577 - DNA, 21 bp, Artificial Sequence
  Description of Artificial Sequence: Synthetic oligonucleotide
  Description of Combined DNA/RNA Molecule: Synthetic oligonucleotide
uggggaagugggugucucgtt

SEQ ID NO: 578 - DNA, 21 bp, Artificial Sequence
  Description of Artificial Sequence: Synthetic oligonucleotide
  Description of Combined DNA/RNA Molecule: Synthetic oligonucleotide
auggggaagugggugucuctt

SEQ ID NO: 579 - DNA, 21 bp, Artificial Sequence
  Description of Artificial Sequence: Synthetic oligonucleotide
  Description of Combined DNA/RNA Molecule: Synthetic oligonucleotide
gauggggaagugggugucutt

SEQ ID NO: 580 - DNA, 21 bp, Artificial Sequence
  Description of Artificial Sequence: Synthetic oligonucleotide
  Description of Combined DNA/RNA Molecule: Synthetic oligonucleotide
gcagauggggaagugggugtt

SEQ ID NO: 581 - DNA, 21 bp, Artificial Sequence
  Description of Artificial Sequence: Synthetic oligonucleotide
  Description of Combined DNA/RNA Molecule: Synthetic oligonucleotide
ucagauggggaagugggugtt

SEQ ID NO: 582 - DNA, 21 bp, Artificial Sequence
  Description of Artificial Sequence: Synthetic oligonucleotide
  Description of Combined DNA/RNA Molecule: Synthetic oligonucleotide
acagauggggaagugggugtt

SEQ ID NO: 583 - DNA, 21 bp, Artificial Sequence
  Description of Artificial Sequence: Synthetic oligonucleotide
  Description of Combined DNA/RNA Molecule: Synthetic oligonucleotide
ugcagauggggaagugggutt

SEQ ID NO: 584 - DNA, 21 bp, Artificial Sequence
  Description of Artificial Sequence: Synthetic oligonucleotide
  Description of Combined DNA/RNA Molecule: Synthetic oligonucleotide
augcagauggggaagugggtt

SEQ ID NO: 585 - DNA, 21 bp, Artificial Sequence
  Description of Artificial Sequence: Synthetic oligonucleotide
  Description of Combined DNA/RNA Molecule: Synthetic oligonucleotide
aaaugcagauggggaagugtt

SEQ ID NO: 586 - DNA, 21 bp, Artificial Sequence
  Description of Artificial Sequence: Synthetic oligonucleotide
  Description of Combined DNA/RNA Molecule: Synthetic oligonucleotide
aaaaugcagauggggaagutt

SEQ ID NO: 587 - DNA, 21 bp, Artificial Sequence
  Description of Artificial Sequence: Synthetic oligonucleotide
  Description of Combined DNA/RNA Molecule: Synthetic oligonucleotide
gaaaaugcagauggggaagtt

SEQ ID NO: 588 - DNA, 21 bp, Artificial Sequence
  Description of Artificial Sequence: Synthetic oligonucleotide
  Description of Combined DNA/RNA Molecule: Synthetic oligonucleotide
agaaaaugcagauggggaatt

SEQ ID NO: 589 - DNA, 21 bp, Artificial Sequence
  Description of Artificial Sequence: Synthetic oligonucleotide
  Description of Combined DNA/RNA Molecule: Synthetic oligonucleotide
agcagaaaaugcagaugggtt

SEQ ID NO: 590 - DNA, 21 bp, Artificial Sequence
  Description of Artificial Sequence: Synthetic oligonucleotide
  Description of Combined DNA/RNA Molecule: Synthetic oligonucleotide
cagcagaaaaugcagauggtt

SEQ ID NO: 591 - DNA, 21 bp, Artificial Sequence
  Description of Artificial Sequence: Synthetic oligonucleotide
  Description of Combined DNA/RNA Molecule: Synthetic oligonucleotide
agccgcagcagaaaaugcatt

SEQ ID NO: 592 - DNA, 21 bp, Artificial Sequence
  Description of Artificial Sequence: Synthetic oligonucleotide
  Description of Combined DNA/RNA Molecule: Synthetic oligonucleotide
cagccgcagcagaaaaugctt

SEQ ID NO: 593 - DNA, 21 bp, Artificial Sequence
  Description of Artificial Sequence: Synthetic oligonucleotide
  Description of Combined DNA/RNA Molecule: Synthetic oligonucleotide
agcagccgcagcagaaaautt

SEQ ID NO: 594 - DNA, 21 bp, Artificial Sequence
  Description of Artificial Sequence: Synthetic oligonucleotide
  Description of Combined DNA/RNA Molecule: Synthetic oligonucleotide
cagcagccgcagcagaaaatt

SEQ ID NO: 595 - DNA, 21 bp, Artificial Sequence
  Description of Artificial Sequence: Synthetic oligonucleotide
  Description of Combined DNA/RNA Molecule: Synthetic oligonucleotide
acagcagccgcagcagaaatt

SEQ ID NO: 596 - DNA, 21 bp, Artificial Sequence
  Description of Artificial Sequence: Synthetic oligonucleotide
  Description of Combined DNA/RNA Molecule: Synthetic oligonucleotide
gacagcagccgcagcagaatt

SEQ ID NO: 597 - DNA, 21 bp, Artificial Sequence
  Description of Artificial Sequence: Synthetic oligonucleotide
  Description of Combined DNA/RNA Molecule: Synthetic oligonucleotide
ugacagcagccgcagcagatt

SEQ ID NO: 598 - DNA, 21 bp, Artificial Sequence
  Description of Artificial Sequence: Synthetic oligonucleotide
  Description of Combined DNA/RNA Molecule: Synthetic oligonucleotide
augacagcagccgcagcagtt

SEQ ID NO: 599 - DNA, 21 bp, Artificial Sequence
  Description of Artificial Sequence: Synthetic oligonucleotide
  Description of Combined DNA/RNA Molecule: Synthetic oligonucleotide
aaugacagcagccgcagcatt

SEQ ID NO: 600 - DNA, 21 bp, Artificial Sequence
  Description of Artificial Sequence: Synthetic oligonucleotide
  Description of Combined DNA/RNA Molecule: Synthetic oligonucleotide
caugacagcagccgcagcatt

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
uaugacagcagccgcagcatt

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
gaugacagcagccgcagcatt

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
ucgaugacagcagccgcagtt

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
aucgaugacagcagccgcatt

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
aaucgaugacagcagccgctt

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
caucgaugacagcagccgctt

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
uaucgaugacagcagccgctt

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
ugaucgaugacagcagccgtt

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
uugaucgaugacagcagcctt

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
uuugaucgaugacagcagctt

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
auuugaucgaugacagcagtt

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
uuuugaucgaugacagcagtt

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
cuuugaucgaugacagcagtt

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
acuuugaucgaugacagcatt

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
aacuuugaucgaugacagctt

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
cacuuugaucgaugacagctt

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
uacuuugaucgaugacagctt

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
acacuuugaucgaugacagtt

SEQ ID NO: 619 - DNA, 21 bp, Artificial Sequence
  Description of Artificial Sequence: Synthetic oligonucleotide
  Description of Combined DNA/RNA Molecule: Synthetic oligonucleotide
aacacuuugaucgaugacatt

SEQ ID NO: 620 - DNA, 21 bp, Artificial Sequence
  Description of Artificial Sequence: Synthetic oligonucleotide
  Description of Combined DNA/RNA Molecule: Synthetic oligonucleotide
cacacuuugaucgaugacatt

SEQ ID NO: 621 - DNA, 21 bp, Artificial Sequence
  Description of Artificial Sequence: Synthetic oligonucleotide
  Description of Combined DNA/RNA Molecule: Synthetic oligonucleotide
uacacuuugaucgaugacatt

SEQ ID NO: 622 - DNA, 21 bp, Artificial Sequence
  Description of Artificial Sequence: Synthetic oligonucleotide
  Description of Combined DNA/RNA Molecule: Synthetic oligonucleotide
uccacacuuugaucgaugatt

SEQ ID NO: 623 - DNA, 21 bp, Artificial Sequence
  Description of Artificial Sequence: Synthetic oligonucleotide
  Description of Combined DNA/RNA Molecule: Synthetic oligonucleotide
accacacuuugaucgaugatt

SEQ ID NO: 624 - DNA, 21 bp, Artificial Sequence
  Description of Artificial Sequence: Synthetic oligonucleotide
  Description of Combined DNA/RNA Molecule: Synthetic oligonucleotide
cccacacuuugaucgaugatt

SEQ ID NO: 625 - DNA, 21 bp, Artificial Sequence
  Description of Artificial Sequence: Synthetic oligonucleotide
  Description of Combined DNA/RNA Molecule: Synthetic oligonucleotide
ucccacacuuugaucgaugtt

SEQ ID NO: 626 - DNA, 21 bp, Artificial Sequence
  Description of Artificial Sequence: Synthetic oligonucleotide
  Description of Combined DNA/RNA Molecule: Synthetic oligonucleotide
aucccacacuuugaucgautt

SEQ ID NO: 627 - DNA, 21 bp, Artificial Sequence
  Description of Artificial Sequence: Synthetic oligonucleotide
  Description of Combined DNA/RNA Molecule: Synthetic oligonucleotide
caucccacacuuugaucgatt

SEQ ID NO: 628 - DNA, 21 bp, Artificial Sequence
  Description of Artificial Sequence: Synthetic oligonucleotide
  Description of Combined DNA/RNA Molecule: Synthetic oligonucleotide
acaucccacacuuugaucgtt

SEQ ID NO: 629 - DNA, 21 bp, Artificial Sequence
  Description of Artificial Sequence: Synthetic oligonucleotide
  Description of Combined DNA/RNA Molecule: Synthetic oligonucleotide
aacaucccacacuuugauctt

SEQ ID NO: 630 - DNA, 21 bp, Artificial Sequence
  Description of Artificial Sequence: Synthetic oligonucleotide
  Description of Combined DNA/RNA Molecule: Synthetic oligonucleotide
cacaucccacacuuugauctt

SEQ ID NO: 631 - DNA, 21 bp, Artificial Sequence
  Description of Artificial Sequence: Synthetic oligonucleotide
  Description of Combined DNA/RNA Molecule: Synthetic oligonucleotide
uacaucccacacuuugauctt

SEQ ID NO: 632 - DNA, 21 bp, Artificial Sequence
  Description of Artificial Sequence: Synthetic oligonucleotide
  Description of Combined DNA/RNA Molecule: Synthetic oligonucleotide
acacaucccacacuuugautt

SEQ ID NO: 633 - DNA, 21 bp, Artificial Sequence
  Description of Artificial Sequence: Synthetic oligonucleotide
  Description of Combined DNA/RNA Molecule: Synthetic oligonucleotide
ucacaucccacacuuugautt

SEQ ID NO: 634 - DNA, 21 bp, Artificial Sequence
  Description of Artificial Sequence: Synthetic oligonucleotide
  Description of Combined DNA/RNA Molecule: Synthetic oligonucleotide
gcacaucccacacuuugautt

SEQ ID NO: 635 - DNA, 21 bp, Artificial Sequence
  Description of Artificial Sequence: Synthetic oligonucleotide
  Description of Combined DNA/RNA Molecule: Synthetic oligonucleotide
agcacaucccacacuuugatt

SEQ ID NO: 636 - DNA, 21 bp, Artificial Sequence
  Description of Artificial Sequence: Synthetic oligonucleotide
  Description of Combined DNA/RNA Molecule: Synthetic oligonucleotide
cagcacaucccacacuuugtt

SEQ ID NO: 637 - DNA, 21 bp, Artificial Sequence
  Description of Artificial Sequence: Synthetic oligonucleotide
  Description of Combined DNA/RNA Molecule: Synthetic oligonucleotide
acagcacaucccacacuuutt

SEQ ID NO: 638 - DNA, 21 bp, Artificial Sequence
  Description of Artificial Sequence: Synthetic oligonucleotide
  Description of Combined DNA/RNA Molecule: Synthetic oligonucleotide
ucagcacaucccacacuuutt

SEQ ID NO: 639 - DNA, 21 bp, Artificial Sequence
  Description of Artificial Sequence: Synthetic oligonucleotide
  Description of Combined DNA/RNA Molecule: Synthetic oligonucleotide
gcagcacaucccacacuuutt

SEQ ID NO: 640 - DNA, 21 bp, Artificial Sequence
  Description of Artificial Sequence: Synthetic oligonucleotide
  Description of Combined DNA/RNA Molecule: Synthetic oligonucleotide
ugcagcacaucccacacuutt

SEQ ID NO: 641 - DNA, 21 bp, Artificial Sequence
  Description of Artificial Sequence: Synthetic oligonucleotide
  Description of Combined DNA/RNA Molecule: Synthetic oligonucleotide
uugcagcacaucccacacutt

SEQ ID NO: 642 - DNA, 21 bp, Artificial Sequence
  Description of Artificial Sequence: Synthetic oligonucleotide
  Description of Combined DNA/RNA Molecule: Synthetic oligonucleotide
acgucuugcagcacauccctt

SEQ ID NO: 643 - DNA, 21 bp, Artificial Sequence
  Description of Artificial Sequence: Synthetic oligonucleotide
  Description of Combined DNA/RNA Molecule: Synthetic oligonucleotide
cacgucuugcagcacaucctt

SEQ ID NO: 644 - DNA, 21 bp, Artificial Sequence
  Description of Artificial Sequence: Synthetic oligonucleotide
  Description of Combined DNA/RNA Molecule: Synthetic oligonucleotide
uacgucuugcagcacaucctt

SEQ ID NO: 645 - DNA, 21 bp, Artificial Sequence
  Description of Artificial Sequence: Synthetic oligonucleotide
  Description of Combined DNA/RNA Molecule: Synthetic oligonucleotide
uccacgucuugcagcacautt

SEQ ID NO: 646 - DNA, 21 bp, Artificial Sequence
  Description of Artificial Sequence: Synthetic oligonucleotide
  Description of Combined DNA/RNA Molecule: Synthetic oligonucleotide
ucuacgucuugcagcacautt

SEQ ID NO: 647 - DNA, 21 bp, Artificial Sequence
  Description of Artificial Sequence: Synthetic oligonucleotide
  Description of Combined DNA/RNA Molecule: Synthetic oligonucleotide
uuccacgucuugcagcacatt

SEQ ID NO: 648 - DNA, 21 bp, Artificial Sequence
  Description of Artificial Sequence: Synthetic oligonucleotide
  Description of Combined DNA/RNA Molecule: Synthetic oligonucleotide
uucuacgucuugcagcacatt

SEQ ID NO: 649 - DNA, 21 bp, Artificial Sequence
  Description of Artificial Sequence: Synthetic oligonucleotide
  Description of Combined DNA/RNA Molecule: Synthetic oligonucleotide
agguuccacgucuugcagctt

SEQ ID NO: 650 - DNA, 21 bp, Artificial Sequence
  Description of Artificial Sequence: Synthetic oligonucleotide
  Description of Combined DNA/RNA Molecule: Synthetic oligonucleotide
agguucuacgucuugcagctt

SEQ ID NO: 651 - DNA, 21 bp, Artificial Sequence
  Description of Artificial Sequence: Synthetic oligonucleotide
  Description of Combined DNA/RNA Molecule: Synthetic oligonucleotide
cagguuccacgucuugcagtt

SEQ ID NO: 652 - DNA, 21 bp, Artificial Sequence
  Description of Artificial Sequence: Synthetic oligonucleotide
  Description of Combined DNA/RNA Molecule: Synthetic oligonucleotide
agggcaggcagguuccacgtt

SEQ ID NO: 653 - DNA, 21 bp, Artificial Sequence
  Description of Artificial Sequence: Synthetic oligonucleotide
  Description of Combined DNA/RNA Molecule: Synthetic oligonucleotide
agggcagguagguucuacgtt

SEQ ID NO: 654 - DNA, 21 bp, Artificial Sequence
  Description of Artificial Sequence: Synthetic oligonucleotide
  Description of Combined DNA/RNA Molecule: Synthetic oligonucleotide
aacaaggaagggaggggactt

SEQ ID NO: 655 - DNA, 21 bp, Artificial Sequence
  Description of Artificial Sequence: Synthetic oligonucleotide
  Description of Combined DNA/RNA Molecule: Synthetic oligonucleotide
aaacaaggaagggaggggatt

SEQ ID NO: 656 - DNA, 21 bp, Artificial Sequence
  Description of Artificial Sequence: Synthetic oligonucleotide
  Description of Combined DNA/RNA Molecule: Synthetic oligonucleotide
caaacaaggaagggaggggtt

SEQ ID NO: 657 - DNA, 21 bp, Artificial Sequence
  Description of Artificial Sequence: Synthetic oligonucleotide
  Description of Combined DNA/RNA Molecule: Synthetic oligonucleotide
acaaacaaggaagggagggtt

SEQ ID NO: 658 - DNA, 21 bp, Artificial Sequence
  Description of Artificial Sequence: Synthetic oligonucleotide
  Description of Combined DNA/RNA Molecule: Synthetic oligonucleotide
aacaaacaaggaagggaggtt

SEQ ID NO: 659 - DNA, 21 bp, Artificial Sequence
  Description of Artificial Sequence: Synthetic oligonucleotide
  Description of Combined DNA/RNA Molecule: Synthetic oligonucleotide
aaacaaacaaggaagggagtt

SEQ ID NO: 660 - DNA, 21 bp, Artificial Sequence
  Description of Artificial Sequence: Synthetic oligonucleotide
  Description of Combined DNA/RNA Molecule: Synthetic oligonucleotide
caacaaacaaggaagggagtt

SEQ ID NO: 661 - DNA, 21 bp, Artificial Sequence
  Description of Artificial Sequence: Synthetic oligonucleotide
  Description of Combined DNA/RNA Molecule: Synthetic oligonucleotide
aggaacaaacaaggaagggtt

SEQ ID NO: 662 - DNA, 21 bp, Artificial Sequence
  Description of Artificial Sequence: Synthetic oligonucleotide
  Description of Combined DNA/RNA Molecule: Synthetic oligonucleotide
caggaacaaacaaggaaggtt

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
aaggaacaaacaaggaaggtt

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
acaggaacaaacaaggaagtt

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
ucaggaacaaacaaggaagtt

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
agcaggaacaaacaaggaatt

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
aagcaggaacaaacaaggatt

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
cagcaggaacaaacaaggatt

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
acagcaggaacaaacaaggtt

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
ucagcaggaacaaacaaggtt

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
uggggcagcaggaacaaautt

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
ucuggggcagcaggaacaatt

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
uucuggggcagcaggaacatt

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
auguucuggggcagcaggatt

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
cauguucuggggcagcaggtt

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
uauguucuggggcagcaggtt

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
acccauguucuggggcagctt

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
accuauguucuggggcagctt

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
agacccauguucuggggcatt

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
agaccuauguucuggggcatt

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
aagaccuauguucuggggctt

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
aagacccauguucuggggctt

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
uccaagaccuauguucucgtt

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
uccaagaccuauguucuggtt

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
uccaagacccauguucuggtt

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
uuccaagacccauguucugtt

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
uuccaagaccuauguucugtt

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
auuccaagacccauguucutt

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
auuccaagaccuauguucutt

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
cauuccaagacccauguuctt

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
tatuccaagaccuauguuctt

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
uauuccaagaccuguguuctt

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
uauucuaagaccuauguuctt

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
ucauuccaagacccauguutt

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
uuauuccaagaccuauguutt

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
uuuuauuccaagaccuaugtt

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
agaaccagccauuuuauuctt

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
agaaccagccauuucauuctt

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
aaagaaccagccauuucautt

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
aaagaaccagccauuuuautt

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
aaaagaaccagccauuucatt

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
aaaagaaccagccauuuuatt

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
aacaaaagaaccagccauutt

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
aaacaaaagaaccagccautt

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
uggaaaacaaaagaaccagtt

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
uauuccaagaccuauguucuu

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
uagguucuacgucuugcagtt

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
gcuggagaauuggauagcatt

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
uggagaauuggauagcagatt

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
gaauuggauagcagaguaatt

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
aauuggauagcagaguaautt

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
auagcagaguaauguuugatt

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
agaguaauguuugaccucutt

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
ucauauuuaagaacaugcatt

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
caugcaggaaugcauugautt

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
caggaaugcauugaucagatt

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
ggcugagguggauaaucuutt

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
uccaguuugucgauucaaatt

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
ugucgauucaaacugcuaatt

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
gauccaagcugccuacauutt

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
ccuacauuggcacaacuautt

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
uacauuggcacaacuauaatt

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
ucaagguagcagaggaugutt

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
ggagcuauaaccauugauatt

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
agcuauaaccauugauacutt

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
ggaagaugcuuacuuccautt

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
gaugcuuacuuccauuccutt

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
cuuacuuccauuccugugutt

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
uuccugugucuuugauguutt

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
uccugugucuuugauguuutt

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
auuucuggugaucccaacutt

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
ccauuuacugcagauuucatt

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
uuagaggucaugaagguuutt

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
uagaggucaugaagguuuutt

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
uuaagaggcaagagcugaatt

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
agacaugaucauuagccautt

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
acaugaucauuagccauaatt

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
ugaucauuagccauaagaatt

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
auuagggaaagaagucuautt

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
uuagggaaagaagucuauutt

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
uagggaaagaagucuauuutt

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
aaagaagucuauuugaugatt

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
aagaagucuauuugaugaatt

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
uguguguaagguauguucutt

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
gugaagggagucucugcuutt

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
ugaagggagucucugcuuutt

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
cacagguaggacagaaguatt

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
acagguaggacagaaguautt

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
agguaggacagaaguaucatt

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
gguaggacagaaguaucautt

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
ggacagaaguaucaucccutt

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
uauuaaagcuacaaauucutt

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
ugcuauccaauucuccagctt

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
ucugcuauccaauucuccatt

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
uuacucugcuauccaauuctt

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
auuacucugcuauccaauutt

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
ucaaacauuacucugcuautt

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
agaggucaaacauuacucutt

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
ugcauguucuuaaauaugatt

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
aucaaugcauuccugcaugtt

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
ucugaucaaugcauuccugtt

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
aagauuauccaccucagcctt

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
uuugaaucgacaaacuggatt

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
uuagcaguuugaaucgacatt

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
aauguaggcagcuuggauctt

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
auaguugugccaauguaggtt

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
uuauaguugugccaauguatt

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
acauccucugcuaccuugatt

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
uaucaaugguuauagcucctt

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
aguaucaaugguuauagcutt

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
auggaaguaagcaucuucctt

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
aggaauggaaguaagcauctt

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
acacaggaauggaaguaagtt

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
aacaucaaagacacaggaatt

SEQ ID NO: 775 - DNA, 21 bp, Artificial Sequence
  Description of Artificial Sequence: Synthetic oligonucleotide
  Description of Combined DNA/RNA Molecule: Synthetic oligonucleotide
aaacaucaaagacacaggatt

SEQ ID NO: 776 - DNA, 21 bp, Artificial Sequence
  Description of Artificial Sequence: Synthetic oligonucleotide
  Description of Combined DNA/RNA Molecule: Synthetic oligonucleotide
aguugggaucaccagaaautt

SEQ ID NO: 777 - DNA, 21 bp, Artificial Sequence
  Description of Artificial Sequence: Synthetic oligonucleotide
  Description of Combined DNA/RNA Molecule: Synthetic oligonucleotide
ugaaaucugcaguaaauggtt

SEQ ID NO: 778 - DNA, 21 bp, Artificial Sequence
  Description of Artificial Sequence: Synthetic oligonucleotide
  Description of Combined DNA/RNA Molecule: Synthetic oligonucleotide
aaaccuucaugaccucuaatt

SEQ ID NO: 779 - DNA, 21 bp, Artificial Sequence
  Description of Artificial Sequence: Synthetic oligonucleotide
  Description of Combined DNA/RNA Molecule: Synthetic oligonucleotide
aaaaccuucaugaccucuatt

SEQ ID NO: 780 - DNA, 21 bp, Artificial Sequence
  Description of Artificial Sequence: Synthetic oligonucleotide
  Description of Combined DNA/RNA Molecule: Synthetic oligonucleotide
uucagcucuugccucuuaatt

SEQ ID NO: 781 - DNA, 21 bp, Artificial Sequence
  Description of Artificial Sequence: Synthetic oligonucleotide
  Description of Combined DNA/RNA Molecule: Synthetic oligonucleotide
auggcuaaugaucaugucutt

SEQ ID NO: 782 - DNA, 21 bp, Artificial Sequence
  Description of Artificial Sequence: Synthetic oligonucleotide
  Description of Combined DNA/RNA Molecule: Synthetic oligonucleotide
uuauggcuaaugaucaugutt

SEQ ID NO: 783 - DNA, 21 bp, Artificial Sequence
  Description of Artificial Sequence: Synthetic oligonucleotide
  Description of Combined DNA/RNA Molecule: Synthetic oligonucleotide
uucuuauggcuaaugaucatt

SEQ ID NO: 784 - DNA, 21 bp, Artificial Sequence
  Description of Artificial Sequence: Synthetic oligonucleotide
  Description of Combined DNA/RNA Molecule: Synthetic oligonucleotide
auagacuucuuucccuaautt

SEQ ID NO: 785 - DNA, 21 bp, Artificial Sequence
  Description of Artificial Sequence: Synthetic oligonucleotide
  Description of Combined DNA/RNA Molecule: Synthetic oligonucleotide
aauagacuucuuucccuaatt

SEQ ID NO: 786 - DNA, 21 bp, Artificial Sequence
  Description of Artificial Sequence: Synthetic oligonucleotide
  Description of Combined DNA/RNA Molecule: Synthetic oligonucleotide
aaauagacuucuuucccuatt

SEQ ID NO: 787 - DNA, 21 bp, Artificial Sequence
  Description of Artificial Sequence: Synthetic oligonucleotide
  Description of Combined DNA/RNA Molecule: Synthetic oligonucleotide
ucaucaaauagacuucuuutt

SEQ ID NO: 788 - DNA, 21 bp, Artificial Sequence
  Description of Artificial Sequence: Synthetic oligonucleotide
  Description of Combined DNA/RNA Molecule: Synthetic oligonucleotide
uucaucaaauagacuucuutt

SEQ ID NO: 789 - DNA, 21 bp, Artificial Sequence
  Description of Artificial Sequence: Synthetic oligonucleotide
  Description of Combined DNA/RNA Molecule: Synthetic oligonucleotide
agaacauaccuuacacacatt

SEQ ID NO: 790 - DNA, 21 bp, Artificial Sequence
  Description of Artificial Sequence: Synthetic oligonucleotide
  Description of Combined DNA/RNA Molecule: Synthetic oligonucleotide
aagcagagacucccuucactt

SEQ ID NO: 791 - DNA, 21 bp, Artificial Sequence
  Description of Artificial Sequence: Synthetic oligonucleotide
  Description of Combined DNA/RNA Molecule: Synthetic oligonucleotide
aaagcagagacucccuucatt

SEQ ID NO: 792 - DNA, 21 bp, Artificial Sequence
  Description of Artificial Sequence: Synthetic oligonucleotide
  Description of Combined DNA/RNA Molecule: Synthetic oligonucleotide
uacuucuguccuaccugugtt

SEQ ID NO: 793 - DNA, 21 bp, Artificial Sequence
  Description of Artificial Sequence: Synthetic oligonucleotide
  Description of Combined DNA/RNA Molecule: Synthetic oligonucleotide
auacuucuguccuaccugutt

SEQ ID NO: 794 - DNA, 21 bp, Artificial Sequence
  Description of Artificial Sequence: Synthetic oligonucleotide
  Description of Combined DNA/RNA Molecule: Synthetic oligonucleotide
ugauacuucuguccuaccutt

SEQ ID NO: 795 - DNA, 21 bp, Artificial Sequence
  Description of Artificial Sequence: Synthetic oligonucleotide
  Description of Combined DNA/RNA Molecule: Synthetic oligonucleotide
augauacuucuguccuacctt

SEQ ID NO: 796 - DNA, 21 bp, Artificial Sequence
  Description of Artificial Sequence: Synthetic oligonucleotide
  Description of Combined DNA/RNA Molecule: Synthetic oligonucleotide
agggaugauacuucugucctt

SEQ ID NO: 797 - DNA, 21 bp, Artificial Sequence
  Description of Artificial Sequence: Synthetic oligonucleotide
  Description of Combined DNA/RNA Molecule: Synthetic oligonucleotide
agaauuuguagcuuuaauatt

SEQ ID NO: 798 - DNA, 21 bp, Artificial Sequence
  Description of Artificial Sequence: Synthetic oligonucleotide
  Description of Combined DNA/RNA Molecule: Synthetic oligonucleotide
uccagagagcgcaacaacutt

SEQ ID NO: 799 - DNA, 21 bp, Artificial Sequence
  Description of Artificial Sequence: Synthetic oligonucleotide
  Description of Combined DNA/RNA Molecule: Synthetic oligonucleotide
cagagagcgcaacaacugutt

SEQ ID NO: 800 - DNA, 21 bp, Artificial Sequence
  Description of Artificial Sequence: Synthetic oligonucleotide
  Description of Combined DNA/RNA Molecule: Synthetic oligonucleotide
agcugguguacgcccacuatt

SEQ ID NO: 801 - DNA, 21 bp, Artificial Sequence
  Description of Artificial Sequence: Synthetic oligonucleotide
  Description of Combined DNA/RNA Molecule: Synthetic oligonucleotide
ccagaaggugaccaaugcutt

SEQ ID NO: 802 - DNA, 21 bp, Artificial Sequence
  Description of Artificial Sequence: Synthetic oligonucleotide
  Description of Combined DNA/RNA Molecule: Synthetic oligonucleotide
agaaggugaccaaugcucatt

SEQ ID NO: 803 - DNA, 21 bp, Artificial Sequence
  Description of Artificial Sequence: Synthetic oligonucleotide
  Description of Combined DNA/RNA Molecule: Synthetic oligonucleotide
gcucaaggagugcucauautt

SEQ ID NO: 804 - DNA, 21 bp, Artificial Sequence
  Description of Artificial Sequence: Synthetic oligonucleotide
  Description of Combined DNA/RNA Molecule: Synthetic oligonucleotide
cucaaggagugcucauauatt

SEQ ID NO: 805 - DNA, 21 bp, Artificial Sequence
  Description of Artificial Sequence: Synthetic oligonucleotide
  Description of Combined DNA/RNA Molecule: Synthetic oligonucleotide
aggagugcucauauacccatt

SEQ ID NO: 806 - DNA, 21 bp, Artificial Sequence
  Description of Artificial Sequence: Synthetic oligonucleotide
  Description of Combined DNA/RNA Molecule: Synthetic oligonucleotide
gagugcucauauacccagatt

SEQ ID NO: 807 - DNA, 21 bp, Artificial Sequence
  Description of Artificial Sequence: Synthetic oligonucleotide
  Description of Combined DNA/RNA Molecule: Synthetic oligonucleotide
acaugugcaccugggaacutt

SEQ ID NO: 808 - DNA, 21 bp, Artificial Sequence
  Description of Artificial Sequence: Synthetic oligonucleotide
  Description of Combined DNA/RNA Molecule: Synthetic oligonucleotide
cuuccuucaaucaaacccatt

SEQ ID NO: 809 - DNA, 21 bp, Artificial Sequence
  Description of Artificial Sequence: Synthetic oligonucleotide
  Description of Combined DNA/RNA Molecule: Synthetic oligonucleotide
uccuucaaucaaacccagutt

SEQ ID NO: 810 - DNA, 21 bp, Artificial Sequence
  Description of Artificial Sequence: Synthetic oligonucleotide
  Description of Combined DNA/RNA Molecule: Synthetic oligonucleotide
guucccuccaguugcaucatt

SEQ ID NO: 811 - DNA, 21 bp, Artificial Sequence
  Description of Artificial Sequence: Synthetic oligonucleotide
  Description of Combined DNA/RNA Molecule: Synthetic oligonucleotide
uucccuccaguugcaucautt

SEQ ID NO: 812 - DNA, 21 bp, Artificial Sequence
  Description of Artificial Sequence: Synthetic oligonucleotide
  Description of Combined DNA/RNA Molecule: Synthetic oligonucleotide
cgcucagagccagaucacutt

SEQ ID NO: 813 - DNA, 21 bp, Artificial Sequence
  Description of Artificial Sequence: Synthetic oligonucleotide
  Description of Combined DNA/RNA Molecule: Synthetic oligonucleotide
aggagcagcuaaauccgcutt

SEQ ID NO: 814 - DNA, 21 bp, Artificial Sequence
  Description of Artificial Sequence: Synthetic oligonucleotide
  Description of Combined DNA/RNA Molecule: Synthetic oligonucleotide
cccgcagaagucuccucuutt

SEQ ID NO: 815 - DNA, 21 bp, Artificial Sequence
  Description of Artificial Sequence: Synthetic oligonucleotide
  Description of Combined DNA/RNA Molecule: Synthetic oligonucleotide
guguacgugagccuggacatt

SEQ ID NO: 816 - DNA, 21 bp, Artificial Sequence
  Description of Artificial Sequence: Synthetic oligonucleotide
  Description of Combined DNA/RNA Molecule: Synthetic oligonucleotide
gacaaguuucaugccaagatt

SEQ ID NO: 817 - DNA, 21 bp, Artificial Sequence
  Description of Artificial Sequence: Synthetic oligonucleotide
  Description of Combined DNA/RNA Molecule: Synthetic oligonucleotide
uucugacaagucucauugatt

SEQ ID NO: 818 - DNA, 21 bp, Artificial Sequence
  Description of Artificial Sequence: Synthetic oligonucleotide
  Description of Combined DNA/RNA Molecule: Synthetic oligonucleotide
cugacaagucucauugagatt

SEQ ID NO: 819 - DNA, 21 bp, Artificial Sequence
  Description of Artificial Sequence: Synthetic oligonucleotide
  Description of Combined DNA/RNA Molecule: Synthetic oligonucleotide
gacaagucucauugagagutt

SEQ ID NO: 820 - DNA, 21 bp, Artificial Sequence
  Description of Artificial Sequence: Synthetic oligonucleotide
  Description of Combined DNA/RNA Molecule: Synthetic oligonucleotide
caagucucauugagagugutt

SEQ ID NO: 821 - DNA, 21 bp, Artificial Sequence
  Description of Artificial Sequence: Synthetic oligonucleotide
  Description of Combined DNA/RNA Molecule: Synthetic oligonucleotide
agcgacugacacgcauguatt

SEQ ID NO: 822 - DNA, 21 bp, Artificial Sequence
  Description of Artificial Sequence: Synthetic oligonucleotide
  Description of Combined DNA/RNA Molecule: Synthetic oligonucleotide
cgacugacacgcauguacatt

SEQ ID NO: 823 - DNA, 21 bp, Artificial Sequence
  Description of Artificial Sequence: Synthetic oligonucleotide
  Description of Combined DNA/RNA Molecule: Synthetic oligonucleotide
gacugacacgcauguacaatt

SEQ ID NO: 824 - DNA, 21 bp, Artificial Sequence
  Description of Artificial Sequence: Synthetic oligonucleotide
  Description of Combined DNA/RNA Molecule: Synthetic oligonucleotide
ugacacgcauguacaacgutt

SEQ ID NO: 825 - DNA, 21 bp, Artificial Sequence
  Description of Artificial Sequence: Synthetic oligonucleotide
  Description of Combined DNA/RNA Molecule: Synthetic oligonucleotide
cgcauguacaacgugcgcatt

SEQ ID NO: 826 - DNA, 21 bp, Artificial Sequence
  Description of Artificial Sequence: Synthetic oligonucleotide
  Description of Combined DNA/RNA Molecule: Synthetic oligonucleotide
gcauguacaacgugcgcautt

SEQ ID NO: 827 - DNA, 21 bp, Artificial Sequence
  Description of Artificial Sequence: Synthetic oligonucleotide
  Description of Combined DNA/RNA Molecule: Synthetic oligonucleotide
auguacaacgugcgcauaatt

SEQ ID NO: 828 - DNA, 21 bp, Artificial Sequence
  Description of Artificial Sequence: Synthetic oligonucleotide
  Description of Combined DNA/RNA Molecule: Synthetic oligonucleotide
uguacaacgugcgcauaautt

SEQ ID NO: 829 - DNA, 21 bp, Artificial Sequence
  Description of Artificial Sequence: Synthetic oligonucleotide
  Description of Combined DNA/RNA Molecule: Synthetic oligonucleotide
uaaugcggguggaguucuatt

SEQ ID NO: 830 - DNA, 21 bp, Artificial Sequence
  Description of Artificial Sequence: Synthetic oligonucleotide
  Description of Combined DNA/RNA Molecule: Synthetic oligonucleotide
guggaguucuacuuccuuutt

SEQ ID NO: 831 - DNA, 21 bp, Artificial Sequence
  Description of Artificial Sequence: Synthetic oligonucleotide
  Description of Combined DNA/RNA Molecule: Synthetic oligonucleotide
cguuccgccacaucuucautt

SEQ ID NO: 832 - DNA, 21 bp, Artificial Sequence
  Description of Artificial Sequence: Synthetic oligonucleotide
  Description of Combined DNA/RNA Molecule: Synthetic oligonucleotide
ggaacauugauaacaacuutt

SEQ ID NO: 833 - DNA, 21 bp, Artificial Sequence
  Description of Artificial Sequence: Synthetic oligonucleotide
  Description of Combined DNA/RNA Molecule: Synthetic oligonucleotide
cagcacagauauccacacatt

SEQ ID NO: 834 - DNA, 21 bp, Artificial Sequence
  Description of Artificial Sequence: Synthetic oligonucleotide
  Description of Combined DNA/RNA Molecule: Synthetic oligonucleotide
ggucauacugucgguuaautt

SEQ ID NO: 835 - DNA, 21 bp, Artificial Sequence
  Description of Artificial Sequence: Synthetic oligonucleotide
  Description of Combined DNA/RNA Molecule: Synthetic oligonucleotide
ucauacugucgguuaaucatt

SEQ ID NO: 836 - DNA, 21 bp, Artificial Sequence
  Description of Artificial Sequence: Synthetic oligonucleotide
  Description of Combined DNA/RNA Molecule: Synthetic oligonucleotide
auacugucgguuaaucagatt

SEQ ID NO: 837 - DNA, 21 bp, Artificial Sequence
  Description of Artificial Sequence: Synthetic oligonucleotide
  Description of Combined DNA/RNA Molecule: Synthetic oligonucleotide
acugucgguuaaucagagatt

SEQ ID NO: 838 - DNA, 21 bp, Artificial Sequence
  Description of Artificial Sequence: Synthetic oligonucleotide
  Description of Combined DNA/RNA Molecule: Synthetic oligonucleotide
gguccuccauaccuagagatt

SEQ ID NO: 839 - DNA, 21 bp, Artificial Sequence
  Description of Artificial Sequence: Synthetic oligonucleotide
  Description of Combined DNA/RNA Molecule: Synthetic oligonucleotide
ucgcuggcaccauagccuutt

SEQ ID NO: 840 - DNA, 21 bp, Artificial Sequence
  Description of Artificial Sequence: Synthetic oligonucleotide
  Description of Combined DNA/RNA Molecule: Synthetic oligonucleotide
caccauagccuuauggccatt

SEQ ID NO: 841 - DNA, 21 bp, Artificial Sequence
  Description of Artificial Sequence: Synthetic oligonucleotide
  Description of Combined DNA/RNA Molecule: Synthetic oligonucleotide
aguuguugcgcucucuggatt

SEQ ID NO: 842 - DNA, 21 bp, Artificial Sequence
  Description of Artificial Sequence: Synthetic oligonucleotide
  Description of Combined DNA/RNA Molecule: Synthetic oligonucleotide
acaguuguugcgcucucugtt

SEQ ID NO: 843 - DNA, 21 bp, Artificial Sequence
  Description of Artificial Sequence: Synthetic oligonucleotide
  Description of Combined DNA/RNA Molecule: Synthetic oligonucleotide
uagugggcguacaccagcutt

SEQ ID NO: 844 - DNA, 21 bp, Artificial Sequence
  Description of Artificial Sequence: Synthetic oligonucleotide
  Description of Combined DNA/RNA Molecule: Synthetic oligonucleotide
agcauuggucaccuucuggtt

SEQ ID NO: 845 - DNA, 21 bp, Artificial Sequence
  Description of Artificial Sequence: Synthetic oligonucleotide
  Description of Combined DNA/RNA Molecule: Synthetic oligonucleotide
ugagcauuggucaccuucutt

SEQ ID NO: 846 - DNA, 21 bp, Artificial Sequence
  Description of Artificial Sequence: Synthetic oligonucleotide
  Description of Combined DNA/RNA Molecule: Synthetic oligonucleotide
auaugagcacuccuugagctt

SEQ ID NO: 847 - DNA, 21 bp, Artificial Sequence
  Description of Artificial Sequence: Synthetic oligonucleotide
  Description of Combined DNA/RNA Molecule: Synthetic oligonucleotide
uauaugagcacuccuugagtt

SEQ ID NO: 848 - DNA, 21 bp, Artificial Sequence
  Description of Artificial Sequence: Synthetic oligonucleotide
  Description of Combined DNA/RNA Molecule: Synthetic oligonucleotide
uggguauaugagcacuccutt

SEQ ID NO: 849 - DNA, 21 bp, Artificial Sequence
  Description of Artificial Sequence: Synthetic oligonucleotide
  Description of Combined DNA/RNA Molecule: Synthetic oligonucleotide
ucuggguauaugagcacuctt

SEQ ID NO: 850 - DNA, 21 bp, Artificial Sequence
  Description of Artificial Sequence: Synthetic oligonucleotide
  Description of Combined DNA/RNA Molecule: Synthetic oligonucleotide
aguucccaggugcacaugutt

SEQ ID NO: 851 - DNA, 21 bp, Artificial Sequence
  Description of Artificial Sequence: Synthetic oligonucleotide
  Description of Combined DNA/RNA Molecule: Synthetic oligonucleotide
uggguuugauugaaggaagtt

SEQ ID NO: 852 - DNA, 21 bp, Artificial Sequence
  Description of Artificial Sequence: Synthetic oligonucleotide
  Description of Combined DNA/RNA Molecule: Synthetic oligonucleotide
acuggguuugauugaaggatt

SEQ ID NO: 853 - DNA, 21 bp, Artificial Sequence
  Description of Artificial Sequence: Synthetic oligonucleotide
  Description of Combined DNA/RNA Molecule: Synthetic oligonucleotide
ugaugcaacuggagggaactt

SEQ ID NO: 854 - DNA, 21 bp, Artificial Sequence
  Description of Artificial Sequence: Synthetic oligonucleotide
  Description of Combined DNA/RNA Molecule: Synthetic oligonucleotide
augaugcaacuggagggaatt

SEQ ID NO: 855 - DNA, 21 bp, Artificial Sequence
  Description of Artificial Sequence: Synthetic oligonucleotide
  Description of Combined DNA/RNA Molecule: Synthetic oligonucleotide
agugaucuggcucugagcgtt

SEQ ID NO: 856 - DNA, 21 bp, Artificial Sequence
  Description of Artificial Sequence: Synthetic oligonucleotide
  Description of Combined DNA/RNA Molecule: Synthetic oligonucleotide
agcggauuuagcugcuccutt

SEQ ID NO: 857 - DNA, 21 bp, Artificial Sequence
  Description of Artificial Sequence: Synthetic oligonucleotide
  Description of Combined DNA/RNA Molecule: Synthetic oligonucleotide
aagaggagacuucugcgggtt

SEQ ID NO: 858 - DNA, 21 bp, Artificial Sequence
  Description of Artificial Sequence: Synthetic oligonucleotide
  Description of Combined DNA/RNA Molecule: Synthetic oligonucleotide
uguccaggcucacguacactt

SEQ ID NO: 859 - DNA, 21 bp, Artificial Sequence
  Description of Artificial Sequence: Synthetic oligonucleotide
  Description of Combined DNA/RNA Molecule: Synthetic oligonucleotide
ucuuggcaugaaacuuguctt

SEQ ID NO: 860 - DNA, 21 bp, Artificial Sequence
  Description of Artificial Sequence: Synthetic oligonucleotide
  Description of Combined DNA/RNA Molecule: Synthetic oligonucleotide
ucaaugagacuugucagaatt

SEQ ID NO: 861 - DNA, 21 bp, Artificial Sequence
  Description of Artificial Sequence: Synthetic oligonucleotide
  Description of Combined DNA/RNA Molecule: Synthetic oligonucleotide
ucucaaugagacuugucagtt

SEQ ID NO: 862 - DNA, 21 bp, Artificial Sequence
  Description of Artificial Sequence: Synthetic oligonucleotide
  Description of Combined DNA/RNA Molecule: Synthetic oligonucleotide
acucucaaugagacuuguctt

SEQ ID NO: 863 - DNA, 21 bp, Artificial Sequence
  Description of Artificial Sequence: Synthetic oligonucleotide
  Description of Combined DNA/RNA Molecule: Synthetic oligonucleotide
acacucucaaugagacuugtt

SEQ ID NO: 864 - DNA, 21 bp, Artificial Sequence
  Description of Artificial Sequence: Synthetic oligonucleotide
  Description of Combined DNA/RNA Molecule: Synthetic oligonucleotide
uacaugcgugucagucgcutt

SEQ ID NO: 865 - DNA, 21 bp, Artificial Sequence
  Description of Artificial Sequence: Synthetic oligonucleotide
  Description of Combined DNA/RNA Molecule: Synthetic oligonucleotide
uguacaugcgugucagucgtt

SEQ ID NO: 866 - DNA, 21 bp, Artificial Sequence
  Description of Artificial Sequence: Synthetic oligonucleotide
  Description of Combined DNA/RNA Molecule: Synthetic oligonucleotide
uuguacaugcgugucaguctt

SEQ ID NO: 867 - DNA, 21 bp, Artificial Sequence
  Description of Artificial Sequence: Synthetic oligonucleotide
  Description of Combined DNA/RNA Molecule: Synthetic oligonucleotide
acguuguacaugcgugucatt

SEQ ID NO: 868 - DNA, 21 bp, Artificial Sequence
  Description of Artificial Sequence: Synthetic oligonucleotide
  Description of Combined DNA/RNA Molecule: Synthetic oligonucleotide
ugcgcacguuguacaugcgtt

SEQ ID NO: 869 - DNA, 21 bp, Artificial Sequence
  Description of Artificial Sequence: Synthetic oligonucleotide
  Description of Combined DNA/RNA Molecule: Synthetic oligonucleotide
augcgcacguuguacaugctt

SEQ ID NO: 870 - DNA, 21 bp, Artificial Sequence
  Description of Artificial Sequence: Synthetic oligonucleotide
  Description of Combined DNA/RNA Molecule: Synthetic oligonucleotide
uuaugcgcacguuguacautt

SEQ ID NO: 871 - DNA, 21 bp, Artificial Sequence
  Description of Artificial Sequence: Synthetic oligonucleotide
  Description of Combined DNA/RNA Molecule: Synthetic oligonucleotide
auuaugcgcacguuguacatt

SEQ ID NO: 872 - DNA, 21 bp, Artificial Sequence
  Description of Artificial Sequence: Synthetic oligonucleotide
  Description of Combined DNA/RNA Molecule: Synthetic oligonucleotide
uagaacuccacccgcauuatt

SEQ ID NO: 873 - DNA, 21 bp, Artificial Sequence
  Description of Artificial Sequence: Synthetic oligonucleotide
  Description of Combined DNA/RNA Molecule: Synthetic oligonucleotide
aaaggaaguagaacuccactt

SEQ ID NO: 874 - DNA, 21 bp, Artificial Sequence
  Description of Artificial Sequence: Synthetic oligonucleotide
  Description of Combined DNA/RNA Molecule: Synthetic oligonucleotide
augaagauguggcggaacgtt

SEQ ID NO: 875 - DNA, 21 bp, Artificial Sequence
  Description of Artificial Sequence: Synthetic oligonucleotide
  Description of Combined DNA/RNA Molecule: Synthetic oligonucleotide
aaguuguuaucaauguucctt

SEQ ID NO: 876 - DNA, 21 bp, Artificial Sequence
  Description of Artificial Sequence: Synthetic oligonucleotide
  Description of Combined DNA/RNA Molecule: Synthetic oligonucleotide
uguguggauaucugugcugtt

SEQ ID NO: 877 - DNA, 21 bp, Artificial Sequence
  Description of Artificial Sequence: Synthetic oligonucleotide
  Description of Combined DNA/RNA Molecule: Synthetic oligonucleotide
auuaaccgacaguaugacctt

SEQ ID NO: 878 - DNA, 21 bp, Artificial Sequence
  Description of Artificial Sequence: Synthetic oligonucleotide
  Description of Combined DNA/RNA Molecule: Synthetic oligonucleotide
ugauuaaccgacaguaugatt

SEQ ID NO: 879 - DNA, 21 bp, Artificial Sequence
  Description of Artificial Sequence: Synthetic oligonucleotide
  Description of Combined DNA/RNA Molecule: Synthetic oligonucleotide
ucugauuaaccgacaguautt

SEQ ID NO: 880 - DNA, 21 bp, Artificial Sequence
  Description of Artificial Sequence: Synthetic oligonucleotide
  Description of Combined DNA/RNA Molecule: Synthetic oligonucleotide
ucucugauuaaccgacagutt

SEQ ID NO: 881 - DNA, 21 bp, Artificial Sequence
  Description of Artificial Sequence: Synthetic oligonucleotide
  Description of Combined DNA/RNA Molecule: Synthetic oligonucleotide
ucucuagguauggaggacctt

SEQ ID NO: 882 - DNA, 21 bp, Artificial Sequence
  Description of Artificial Sequence: Synthetic oligonucleotide
  Description of Combined DNA/RNA Molecule: Synthetic oligonucleotide
aaggcuauggugccagcgatt

SEQ ID NO: 883 - DNA, 21 bp, Artificial Sequence
  Description of Artificial Sequence: Synthetic oligonucleotide
  Description of Combined DNA/RNA Molecule: Synthetic oligonucleotide
uggccauaaggcuauggugtt

SEQ ID NO: 884 - RNA, 19 nt, Artificial Sequence
  Description of Artificial Sequence: Synthetic oligonucleotide
augccugucugagcauugu

SEQ ID NO: 885 - RNA, 19 nt, Artificial Sequence
  Description of Artificial Sequence: Synthetic oligonucleotide
auguuaaauauugucagua

SEQ ID NO: 886 - RNA, 19 nt, Artificial Sequence
  Description of Artificial Sequence: Synthetic oligonucleotide
ucugugugaauccauauca

SEQ ID NO: 887 - RNA, 19 nt, Artificial Sequence
  Description of Artificial Sequence: Synthetic oligonucleotide
acuuaccaucauaacagca

SEQ ID NO: 888 - RNA, 19 nt, Artificial Sequence
  Description of Artificial Sequence: Synthetic oligonucleotide
acaaugagcuugcauucca

SEQ ID NO: 889 - RNA, 19 nt, Artificial Sequence
  Description of Artificial Sequence: Synthetic oligonucleotide
uguucauaagaucuaccca

SEQ ID NO: 890 - RNA, 19 nt, Artificial Sequence
  Description of Artificial Sequence: Synthetic oligonucleotide
aaaagaugaauuggauucu

SEQ ID NO: 891 - RNA, 19 nt, Artificial Sequence
  Description of Artificial Sequence: Synthetic oligonucleotide
uguuaaauauugucaguau

SEQ ID NO: 892 - RNA, 19 nt, Artificial Sequence
  Description of Artificial Sequence: Synthetic oligonucleotide
ugugugaauccauaucacu

SEQ ID NO: 893 - RNA, 19 nt, Artificial Sequence
  Description of Artificial Sequence: Synthetic oligonucleotide
uaccaccuggacuggaagu

SEQ ID NO: 894 - RNA, 19 nt, Artificial Sequence
  Description of Artificial Sequence: Synthetic oligonucleotide
gcauuccagccucccauuu

SEQ ID NO: 895 - RNA, 19 nt, Artificial Sequence
  Description of Artificial Sequence: Synthetic oligonucleotide
guucauaagaucuacccaa

SEQ ID NO: 896 - RNA, 19 nt, Artificial Sequence
  Description of Artificial Sequence: Synthetic oligonucleotide
ggauucuuuaauaacagcu

SEQ ID NO: 897 - RNA, 19 nt, Artificial Sequence
  Description of Artificial Sequence: Synthetic oligonucleotide
aaauauugucaguaugcgu

SEQ ID NO: 898 - RNA, 19 nt, Artificial Sequence
  Description of Artificial Sequence: Synthetic oligonucleotide
gugugaauccauaucacua

SEQ ID NO: 899 - RNA, 19 nt, Artificial Sequence
  Description of Artificial Sequence: Synthetic oligonucleotide
cuggacuggaaguaggacu

SEQ ID NO: 900 - RNA, 19 nt, Artificial Sequence
  Description of Artificial Sequence: Synthetic oligonucleotide
ccagccucccauuuccaau

SEQ ID NO: 901 - RNA, 19 nt, Artificial Sequence
  Description of Artificial Sequence: Synthetic oligonucleotide
uauuucuaggcacaagguu

SEQ ID NO: 902 - RNA, 19 nt, Artificial Sequence
  Description of Artificial Sequence: Synthetic oligonucleotide
uuuaauaacagcuauaacu

SEQ ID NO: 903 - RNA, 19 nt, Artificial Sequence
  Description of Artificial Sequence: Synthetic oligonucleotide
aauauugucaguaugcguu

SEQ ID NO: 904 - RNA, 19 nt, Artificial Sequence
  Description of Artificial Sequence: Synthetic oligonucleotide
auugaucucucaggauuaa

SEQ ID NO: 905 - RNA, 19 nt, Artificial Sequence
  Description of Artificial Sequence: Synthetic oligonucleotide
uaggacugcaccauacaca

SEQ ID NO: 906 - RNA, 19 nt, Artificial Sequence
  Description of Artificial Sequence: Synthetic oligonucleotide
gccucccauuuccaaucau

SEQ ID NO: 907 - RNA, 19 nt, Artificial Sequence
  Description of Artificial Sequence: Synthetic oligonucleotide
aauauuuuggaaacugcua

SEQ ID NO: 908 - RNA, 19 nt, Artificial Sequence
  Description of Artificial Sequence: Synthetic oligonucleotide
aauaacagcuauaacuaca

SEQ ID NO: 909 - RNA, 19 nt, Artificial Sequence
  Description of Artificial Sequence: Synthetic oligonucleotide
auugucaguaugcguuuga

SEQ ID NO: 910 - RNA, 19 nt, Artificial Sequence
  Description of Artificial Sequence: Synthetic oligonucleotide
cuguggcuuccacaaguca

SEQ ID NO: 911 - RNA, 19 nt, Artificial Sequence
  Description of Artificial Sequence: Synthetic oligonucleotide
gcaccauacacaccuaauu

SEQ ID NO: 912 - RNA, 19 nt, Artificial Sequence
  Description of Artificial Sequence: Synthetic oligonucleotide
guuggaauguaaaggugaa

SEQ ID NO: 913 - RNA, 19 nt, Artificial Sequence
  Description of Artificial Sequence: Synthetic oligonucleotide
uaaauacugugcagaauaa

SEQ ID NO: 914 - RNA, 19 nt, Artificial Sequence
  Description of Artificial Sequence: Synthetic oligonucleotide
cauacagagaacauuggau

SEQ ID NO: 915 - RNA, 19 nt, Artificial Sequence
  Description of Artificial Sequence: Synthetic oligonucleotide
ugucaguaugcguuugacu

SEQ ID NO: 916 - RNA, 19 nt, Artificial Sequence
  Description of Artificial Sequence: Synthetic oligonucleotide
agugaaggacuguugcaga

SEQ ID NO: 917 - RNA, 19 nt, Artificial Sequence
  Description of Artificial Sequence: Synthetic oligonucleotide
auacacaccuaauuugccu

SEQ ID NO: 918 - RNA, 19 nt, Artificial Sequence
  Description of Artificial Sequence: Synthetic oligonucleotide
ucaggugccuuagugacca

SEQ ID NO: 919 - RNA, 19 nt, Artificial Sequence
  Description of Artificial Sequence: Synthetic oligonucleotide
ucggaaaggauuuccucau

SEQ ID NO: 920 - RNA, 19 nt, Artificial Sequence
  Description of Artificial Sequence: Synthetic oligonucleotide
gucaguaugcguuugacuu

SEQ ID NO: 921 - RNA, 19 nt, Artificial Sequence
  Description of Artificial Sequence: Synthetic oligonucleotide
cagcuacuuaccaucauaa

SEQ ID NO: 922 - RNA, 19 nt, Artificial Sequence
  Description of Artificial Sequence: Synthetic oligonucleotide
aauuugccucaccaccaaa

SEQ ID NO: 923 - RNA, 19 nt, Artificial Sequence
  Description of Artificial Sequence: Synthetic oligonucleotide
cacgcggucuuuguacaga

SEQ ID NO: 924 - RNA, 19 nt, Artificial Sequence
  Description of Artificial Sequence: Synthetic oligonucleotide
cauguuaaauauugucagu

SEQ ID NO: 925 - RNA, 19 nt, Artificial Sequence
  Description of Artificial Sequence: Synthetic oligonucleotide
ugcguuugacuuaaaaugu

SEQ ID NO: 926 - RNA, 19 nt, Artificial Sequence
  Description of Artificial Sequence: Synthetic oligonucleotide
gcuacuuaccaucauaaca

SEQ ID NO: 927 - RNA, 19 nt, Artificial Sequence
  Description of Artificial Sequence: Synthetic oligonucleotide
auuugccucaccaccaaaa

SEQ ID NO: 928 - RNA, 19 nt, Artificial Sequence
  Description of Artificial Sequence: Synthetic oligonucleotide
cgcggucuuuguacagagu

SEQ ID NO: 929 - RNA, 19 nt, Artificial Sequence
  Description of Artificial Sequence: Synthetic oligonucleotide
acaaugcucagacaggcau

SEQ ID NO: 930 - RNA, 19 nt, Artificial Sequence
  Description of Artificial Sequence: Synthetic oligonucleotide
uacugacaauauuuaacau

SEQ ID NO: 931 - RNA, 19 nt, Artificial Sequence
  Description of Artificial Sequence: Synthetic oligonucleotide
ugauauggauucacacaga

SEQ ID NO: 932 - RNA, 19 nt, Artificial Sequence
  Description of Artificial Sequence: Synthetic oligonucleotide
ugcuguuaugaugguaagu

SEQ ID NO: 933 - RNA, 19 nt, Artificial Sequence
  Description of Artificial Sequence: Synthetic oligonucleotide
uggaaugcaagcucauugu

SEQ ID NO: 934 - RNA, 19 nt, Artificial Sequence
  Description of Artificial Sequence: Synthetic oligonucleotide
uggguagaucuuaugaaca

SEQ ID NO: 935 - RNA, 19 nt, Artificial Sequence
  Description of Artificial Sequence: Synthetic oligonucleotide
agaauccaauucaucuuuu

SEQ ID NO: 936 - RNA, 19 nt, Artificial Sequence
  Description of Artificial Sequence: Synthetic oligonucleotide
auacugacaauauuuaaca

SEQ ID NO: 937 - RNA, 19 nt, Artificial Sequence
  Description of Artificial Sequence: Synthetic oligonucleotide
agugauauggauucacaca

SEQ ID NO: 938 - RNA, 19 nt, Artificial Sequence
  Description of Artificial Sequence: Synthetic oligonucleotide
acuuccaguccagguggua

SEQ ID NO: 939 - RNA, 19 nt, Artificial Sequence
  Description of Artificial Sequence: Synthetic oligonucleotide
aaaugggaggcuggaaugc

SEQ ID NO: 940 - RNA, 19 nt, Artificial Sequence
  Description of Artificial Sequence: Synthetic oligonucleotide
uuggguagaucuuaugaac

SEQ ID NO: 941 - RNA, 19 nt, Artificial Sequence
  Description of Artificial Sequence: Synthetic oligonucleotide
agcuguuauuaaagaaucc

SEQ ID NO: 942 - RNA, 19 nt, Artificial Sequence
  Description of Artificial Sequence: Synthetic oligonucleotide
acgcauacugacaauauuu

SEQ ID NO: 943 - RNA, 19 nt, Artificial Sequence
  Description of Artificial Sequence: Synthetic oligonucleotide
uagugauauggauucacac

SEQ ID NO: 944 - RNA, 19 nt, Artificial Sequence
  Description of Artificial Sequence: Synthetic oligonucleotide
aguccuacuuccaguccag

SEQ ID NO: 945 - RNA, 19 nt, Artificial Sequence
  Description of Artificial Sequence: Synthetic oligonucleotide
auuggaaaugggaggcugg

SEQ ID NO: 946 - RNA, 19 nt, Artificial Sequence
  Description of Artificial Sequence: Synthetic oligonucleotide
aaccuugugccuagaaaua

SEQ ID NO: 947 - RNA, 19 nt, Artificial Sequence
  Description of Artificial Sequence: Synthetic oligonucleotide
aguuauagcuguuauuaaa

SEQ ID NO: 948 - RNA, 19 nt, Artificial Sequence
  Description of Artificial Sequence: Synthetic oligonucleotide
aacgcauacugacaauauu

SEQ ID NO: 949 - RNA, 19 nt, Artificial Sequence
  Description of Artificial Sequence: Synthetic oligonucleotide
uuaauccugagagaucaau

SEQ ID NO: 950 - RNA, 19 nt, Artificial Sequence
  Description of Artificial Sequence: Synthetic oligonucleotide
uguguauggugcaguccua

SEQ ID NO: 951 - RNA, 19 nt, Artificial Sequence
  Description of Artificial Sequence: Synthetic oligonucleotide
augauuggaaaugggaggc

SEQ ID NO: 952 - RNA, 19 nt, Artificial Sequence
  Description of Artificial Sequence: Synthetic oligonucleotide
uagcaguuuccaaaauauu

SEQ ID NO: 953 - RNA, 19 nt, Artificial Sequence
  Description of Artificial Sequence: Synthetic oligonucleotide
uguaguuauagcuguuauu

SEQ ID NO: 954 - RNA, 19 nt, Artificial Sequence
  Description of Artificial Sequence: Synthetic oligonucleotide
ucaaacgcauacugacaau

SEQ ID NO: 955 - RNA, 19 nt, Artificial Sequence
  Description of Artificial Sequence: Synthetic oligonucleotide
ugacuuguggaagccacag

SEQ ID NO: 956 - RNA, 19 nt, Artificial Sequence
  Description of Artificial Sequence: Synthetic oligonucleotide
aauuagguguguauggugc

SEQ ID NO: 957 - RNA, 19 nt, Artificial Sequence
  Description of Artificial Sequence: Synthetic oligonucleotide
uucaccuuuacauuccaac

SEQ ID NO: 958 - RNA, 19 nt, Artificial Sequence
  Description of Artificial Sequence: Synthetic oligonucleotide
uuauucugcacaguauuua

SEQ ID NO: 959 - RNA, 19 nt, Artificial Sequence
  Description of Artificial Sequence: Synthetic oligonucleotide
auccaauguucucuguaug

SEQ ID NO: 960 - RNA, 19 nt, Artificial Sequence
  Description of Artificial Sequence: Synthetic oligonucleotide
agucaaacgcauacugaca

SEQ ID NO: 961 - RNA, 19 nt, Artificial Sequence
  Description of Artificial Sequence: Synthetic oligonucleotide
ucugcaacaguccuucacu

SEQ ID NO: 962 - RNA, 19 nt, Artificial Sequence
  Description of Artificial Sequence: Synthetic oligonucleotide
aggcaaauuagguguguau

SEQ ID NO: 963 - RNA, 19 nt, Artificial Sequence
  Description of Artificial Sequence: Synthetic oligonucleotide
uggucacuaaggcaccuga

SEQ ID NO: 964 - RNA, 19 nt, Artificial Sequence
  Description of Artificial Sequence: Synthetic oligonucleotide
augaggaaauccuuuccga

SEQ ID NO: 965 - RNA, 19 nt, Artificial Sequence
  Description of Artificial Sequence: Synthetic oligonucleotide
aagucaaacgcauacugac

SEQ ID NO: 966 - RNA, 19 nt, Artificial Sequence
  Description of Artificial Sequence: Synthetic oligonucleotide
uuaugaugguaaguagcug

SEQ ID NO: 967 - RNA, 19 nt, Artificial Sequence
  Description of Artificial Sequence: Synthetic oligonucleotide
uuugguggugaggcaaauu

SEQ ID NO: 968 - RNA, 19 nt, Artificial Sequence
  Description of Artificial Sequence: Synthetic oligonucleotide
ucuguacaaagaccgcgug

SEQ ID NO: 969 - RNA, 19 nt, Artificial Sequence
  Description of Artificial Sequence: Synthetic oligonucleotide
acugacaauauuuaacaug

SEQ ID NO: 970 - RNA, 19 nt, Artificial Sequence
  Description of Artificial Sequence: Synthetic oligonucleotide
acauuuuaagucaaacgca

SEQ ID NO: 971 - RNA, 19 nt, Artificial Sequence
  Description of Artificial Sequence: Synthetic oligonucleotide
uguuaugaugguaaguagc

SEQ ID NO: 972 - RNA, 19 nt, Artificial Sequence
  Description of Artificial Sequence: Synthetic oligonucleotide
uuuugguggugaggcaaau

SEQ ID NO: 973 - RNA, 19 nt, Artificial Sequence
  Description of Artificial Sequence: Synthetic oligonucleotide
acucuguacaaagaccgcg

SEQ ID NO: 974 - DNA, 21 bp, Artificial Sequence
  Description of Artificial Sequence: Synthetic oligonucleotide
  Description of Combined DNA/RNA Molecule: Synthetic oligonucleotide
augccugucugagcauugutt

SEQ ID NO: 975 - DNA, 21 bp, Artificial Sequence
  Description of Artificial Sequence: Synthetic oligonucleotide
  Description of Combined DNA/RNA Molecule: Synthetic oligonucleotide
auguuaaauauugucaguatt

SEQ ID NO: 976 - DNA, 21 bp, Artificial Sequence
  Description of Artificial Sequence: Synthetic oligonucleotide
  Description of Combined DNA/RNA Molecule: Synthetic oligonucleotide
ucugugugaauccauaucatt

SEQ ID NO: 977 - DNA, 21 bp, Artificial Sequence
  Description of Artificial Sequence: Synthetic oligonucleotide
  Description of Combined DNA/RNA Molecule: Synthetic oligonucleotide
acuuaccaucauaacagcatt

SEQ ID NO: 978 - DNA, 21 bp, Artificial Sequence
  Description of Artificial Sequence: Synthetic oligonucleotide
  Description of Combined DNA/RNA Molecule: Synthetic oligonucleotide
acaaugagcuugcauuccatt

SEQ ID NO: 979 - DNA, 21 bp, Artificial Sequence
  Description of Artificial Sequence: Synthetic oligonucleotide
  Description of Combined DNA/RNA Molecule: Synthetic oligonucleotide
uguucauaagaucuacccatt

SEQ ID NO: 980 - DNA, 21 bp, Artificial Sequence
  Description of Artificial Sequence: Synthetic oligonucleotide
  Description of Combined DNA/RNA Molecule: Synthetic oligonucleotide
aaaagaugaauuggauucutt

SEQ ID NO: 981 - DNA, 21 bp, Artificial Sequence
  Description of Artificial Sequence: Synthetic oligonucleotide
  Description of Combined DNA/RNA Molecule: Synthetic oligonucleotide
uguuaaauauugucaguautt

SEQ ID NO: 982 - DNA, 21 bp, Artificial Sequence
  Description of Artificial Sequence: Synthetic oligonucleotide
  Description of Combined DNA/RNA Molecule: Synthetic oligonucleotide
ugugugaauccauaucacutt

SEQ ID NO: 983 - DNA, 21 bp, Artificial Sequence
  Description of Artificial Sequence: Synthetic oligonucleotide
  Description of Combined DNA/RNA Molecule: Synthetic oligonucleotide
uaccaccuggacuggaagutt

SEQ ID NO: 984 - DNA, 21 bp, Artificial Sequence
  Description of Artificial Sequence: Synthetic oligonucleotide
  Description of Combined DNA/RNA Molecule: Synthetic oligonucleotide
gcauuccagccucccauuutt

SEQ ID NO: 985 - DNA, 21 bp, Artificial Sequence
  Description of Artificial Sequence: Synthetic oligonucleotide
  Description of Combined DNA/RNA Molecule: Synthetic oligonucleotide
guucauaagaucuacccaatt

SEQ ID NO: 986 - DNA, 21 bp, Artificial Sequence
  Description of Artificial Sequence: Synthetic oligonucleotide
  Description of Combined DNA/RNA Molecule: Synthetic oligonucleotide
ggauucuuuaauaacagcutt

SEQ ID NO: 987 - DNA, 21 bp, Artificial Sequence
  Description of Artificial Sequence: Synthetic oligonucleotide
  Description of Combined DNA/RNA Molecule: Synthetic oligonucleotide
aaauauugucaguaugcgutt

SEQ ID NO: 988 - DNA, 21 bp, Artificial Sequence
  Description of Artificial Sequence: Synthetic oligonucleotide
  Description of Combined DNA/RNA Molecule: Synthetic oligonucleotide
gugugaauccauaucacuatt

SEQ ID NO: 989 - DNA, 21 bp, Artificial Sequence
  Description of Artificial Sequence: Synthetic oligonucleotide
  Description of Combined DNA/RNA Molecule: Synthetic oligonucleotide
cuggacuggaaguaggacutt

SEQ ID NO: 990 - DNA, 21 bp, Artificial Sequence
  Description of Artificial Sequence: Synthetic oligonucleotide
  Description of Combined DNA/RNA Molecule: Synthetic oligonucleotide
ccagccucccauuuccaautt

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
uauuucuaggcacaagguutt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
uuuaauaacagcuauaacutt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
aauauugucaguaugcguutt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
auugaucucucaggauuaatt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
uaggacugcaccauacacatt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
gccucccauuuccaaucautt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
aauauuuuggaaacugcuatt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
aauaacagcuauaacuacatt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
auugucaguaugcguuugatt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
cuguggcuuccacaagucatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
gcaccauacacaccuaauutt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
guuggaauguaaaggugaatt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
uaaauacugugcagaauaatt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
cauacagagaacauuggautt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
ugucaguaugcguuugacutt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
agugaaggacuguugcagatt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
auacacaccuaauuugccutt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
ucaggugccuuagugaccatt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
ucggaaaggauuuccucautt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
gucaguaugcguuugacuutt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
gucaguaugcguuugacuutt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
cagcuacuuaccaucauaatt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
aauuugccucaccaccaaatt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
cacgcggucuuuguacagatt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
cauguuaaauauugucagutt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
ugcguuugacuuaaaaugutt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
gcuacuuaccaucauaacatt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
auuugccucaccaccaaaatt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
cgcggucuuuguacagagutt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
acaaugcucagacaggcautt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
uacugacaauauuuaacautt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
ugauauggauucacacagatt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
ugcuguuaugaugguaagutt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
uggaaugcaagcucauugutt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
uggguagaucuuaugaacatt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
agaauccaauucaucuuuutt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
auacugacaauauuuaacatt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
agugauauggauucacacatt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
acuuccaguccaggugguatt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
aaaugggaggcuggaaugctt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
uuggguagaucuuaugaactt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
agcuguuauuaaagaaucctt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
acgcauacugacaauauuutt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
uagugauauggauucacactt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
aguccuacuuccaguccagtt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
auuggaaaugggaggcuggtt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
aaccuugugccuagaaauatt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
aguuauagcuguuauuaaatt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
aacgcauacugacaauauutt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
uuaauccugagagaucaautt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
uguguauggugcaguccuatt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
augauuggaaaugggaggctt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
uagcaguuuccaaaauauutt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
uguaguuauagcuguuauutt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
ucaaacgcauacugacaautt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
ugacuuguggaagccacagtt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
aauuagguguguauggugctt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
uucaccuuuacauuccaactt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
uuauucugcacaguauuuatt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
auccaauguucucuguaugtt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
agucaaacgcauacugacatt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
ucugcaacaguccuucacutt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
aggcaaauuagguguguautt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
uggucacuaaggcaccugatt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
augaggaaauccuuuccgatt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
aagucaaacgcauacugactt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
aagucaaacgcauacugactt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
uuaugaugguaaguagcugtt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
uuugguggugaggcaaauutt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
ucuguacaaagaccgcgugtt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
acugacaauauuuaacaugtt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
acauuuuaagucaaacgcatt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
uguuaugaugguaaguagctt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
uuuugguggugaggcaaautt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
acucuguacaaagaccgcgtt

SEQ ID NO: 1066 - RNA, 19 nt, Artificial Sequence
  Description of Artificial Sequence: Synthetic oligonucleotide
cuccgagaguagcuaugaa

SEQ ID NO: 1067 - RNA, 19 nt, Artificial Sequence
  Description of Artificial Sequence: Synthetic oligonucleotide
gcucuucuguuauauuaaa

SEQ ID NO: 1068 - RNA, 19 nt, Artificial Sequence
  Description of Artificial Sequence: Synthetic oligonucleotide
gaguguagacauuggcauu

SEQ ID NO: 1069 - RNA, 19 nt, Artificial Sequence
  Description of Artificial Sequence: Synthetic oligonucleotide
ggaauuguacagaguacga

SEQ ID NO: 1070 - RNA, 19 nt, Artificial Sequence
  Description of Artificial Sequence: Synthetic oligonucleotide
ggaauuguacagaguacga

SEQ ID NO: 1071 - RNA, 19 nt, Artificial Sequence
  Description of Artificial Sequence: Synthetic oligonucleotide
gacuaaugaaggaccuaaa

SEQ ID NO: 1072 - RNA, 19 nt, Artificial Sequence
  Description of Artificial Sequence: Synthetic oligonucleotide
gaaccaucacauucacuca

SEQ ID NO: 1073 - RNA, 19 nt, Artificial Sequence
  Description of Artificial Sequence: Synthetic oligonucleotide
guguagacauuggcauuua

SEQ ID NO: 1074 - RNA, 19 nt, Artificial Sequence
  Description of Artificial Sequence: Synthetic oligonucleotide
cucaguuagaggcucuucu

SEQ ID NO: 1075 - RNA, 19 nt, Artificial Sequence
  Description of Artificial Sequence: Synthetic oligonucleotide
gaugaugcugggacuuauu

SEQ ID NO: 1076 - RNA, 19 nt, Artificial Sequence
  Description of Artificial Sequence: Synthetic oligonucleotide
cucucaguuagaggcucuu

SEQ ID NO: 1077 - RNA, 19 nt, Artificial Sequence
  Description of Artificial Sequence: Synthetic oligonucleotide
cauuggcauuuauguacaa

SEQ ID NO: 1078 - RNA, 19 nt, Artificial Sequence
  Description of Artificial Sequence: Synthetic oligonucleotide
gcaggucuuccaagauuua

SEQ ID NO: 1079 - RNA, 19 nt, Artificial Sequence
  Description of Artificial Sequence: Synthetic oligonucleotide
ccuagaugaaacucguguu

SEQ ID NO: 1080 - RNA, 19 nt, Artificial Sequence
  Description of Artificial Sequence: Synthetic oligonucleotide
gcauugcuguuuguaagcu

SEQ ID NO: 1081 - RNA, 19 nt, Artificial Sequence
  Description of Artificial Sequence: Synthetic oligonucleotide
guggugcauuccaaacaca

SEQ ID NO: 1082 - RNA, 19 nt, Artificial Sequence
  Description of Artificial Sequence: Synthetic oligonucleotide
guuuugggucuggugaaau

SEQ ID NO: 1083 - RNA, 19 nt, Artificial Sequence
  Description of Artificial Sequence: Synthetic oligonucleotide
gccugugauuagugcccau

SEQ ID NO: 1084 - RNA, 19 nt, Artificial Sequence
  Description of Artificial Sequence: Synthetic oligonucleotide
ggaugaugcugggacuuau

SEQ ID NO: 1085 - RNA, 19 nt, Artificial Sequence
  Description of Artificial Sequence: Synthetic oligonucleotide
gcucaaaauaagcauggcu

SEQ ID NO: 1086 - RNA, 19 nt, Artificial Sequence
  Description of Artificial Sequence: Synthetic oligonucleotide
ccgagugguggccuacaau

SEQ ID NO: 1087 - RNA, 19 nt, Artificial Sequence
  Description of Artificial Sequence: Synthetic oligonucleotide
ggaguguagacauuggcau

SEQ ID NO: 1088 - RNA, 19 nt, Artificial Sequence
  Description of Artificial Sequence: Synthetic oligonucleotide
ggacuaaugaaggaccuaa

SEQ ID NO: 1089 - RNA, 19 nt, Artificial Sequence
  Description of Artificial Sequence: Synthetic oligonucleotide
ccucgauaacccucaccau

SEQ ID NO: 1090 - RNA, 19 nt, Artificial Sequence
  Description of Artificial Sequence: Synthetic oligonucleotide
gauguugcuguucgaacau

SEQ ID NO: 1091 - RNA, 19 nt, Artificial Sequence
  Description of Artificial Sequence: Synthetic oligonucleotide
gggucuggugaaaucagau

SEQ ID NO: 1092 - RNA, 19 nt, Artificial Sequence
  Description of Artificial Sequence: Synthetic oligonucleotide
cuccagcagccucgcuucu

SEQ ID NO: 1093 - RNA, 19 nt, Artificial Sequence
  Description of Artificial Sequence: Synthetic oligonucleotide
gcuccucagaaucuguccu

SEQ ID NO: 1094 - RNA, 19 nt, Artificial Sequence
  Description of Artificial Sequence: Synthetic oligonucleotide
ccauccauucccucgauaa

SEQ ID NO: 1095 - RNA, 19 nt, Artificial Sequence
  Description of Artificial Sequence: Synthetic oligonucleotide
cucagcugauugaaggucu

SEQ ID NO: 1096 - RNA, 19 nt, Artificial Sequence
  Description of Artificial Sequence: Synthetic oligonucleotide
ggcccauuggcacauccau

SEQ ID NO: 1097 - RNA, 19 nt, Artificial Sequence
  Description of Artificial Sequence: Synthetic oligonucleotide
cccauggcccauuggcaca

SEQ ID NO: 1098 - RNA, 19 nt, Artificial Sequence
  Description of Artificial Sequence: Synthetic oligonucleotide
guaccuggauacugccaca

SEQ ID NO: 1099 - RNA, 19 nt, Artificial Sequence
  Description of Artificial Sequence: Synthetic oligonucleotide
caauucugaauugugaagu

SEQ ID NO: 1100 - RNA, 19 nt, Artificial Sequence
  Description of Artificial Sequence: Synthetic oligonucleotide
caccuggaaggacuaauga

SEQ ID NO: 1101 - RNA, 19 nt, Artificial Sequence
  Description of Artificial Sequence: Synthetic oligonucleotide
ccaacuccaacugugaagu

SEQ ID NO: 1102 - RNA, 19 nt, Artificial Sequence
  Description of Artificial Sequence: Synthetic oligonucleotide
gaaggagccggccuccuau

SEQ ID NO: 1103 - RNA, 19 nt, Artificial Sequence
  Description of Artificial Sequence: Synthetic oligonucleotide
cuugaaaacaaggaauugu

SEQ ID NO: 1104 - RNA, 19 nt, Artificial Sequence
  Description of Artificial Sequence: Synthetic oligonucleotide
gcuaugaaccagaugagcu

SEQ ID NO: 1105 - RNA, 19 nt, Artificial Sequence
  Description of Artificial Sequence: Synthetic oligonucleotide
gauacaugacuggguuauu

SEQ ID NO: 1106 - RNA, 19 nt, Artificial Sequence
  Description of Artificial Sequence: Synthetic oligonucleotide
gaagacuccgagaguagcu

SEQ ID NO: 1107 - RNA, 19 nt, Artificial Sequence
  Description of Artificial Sequence: Synthetic oligonucleotide
ggccuacaauaaacauggu

SEQ ID NO: 1108 - RNA, 19 nt, Artificial Sequence
  Description of Artificial Sequence: Synthetic oligonucleotide
guacacacuuguuuggccu

SEQ ID NO: 1109 - RNA, 19 nt, Artificial Sequence
  Description of Artificial Sequence: Synthetic oligonucleotide
guuuggccuuuucuguagu

SEQ ID NO: 1110 - RNA, 19 nt, Artificial Sequence
  Description of Artificial Sequence: Synthetic oligonucleotide
uucauagcuacucucggag

SEQ ID NO: 1111 - RNA, 19 nt, Artificial Sequence
  Description of Artificial Sequence: Synthetic oligonucleotide
uuuaauauaacagaagagc

SEQ ID NO: 1112 - RNA, 19 nt, Artificial Sequence
  Description of Artificial Sequence: Synthetic oligonucleotide
aaugccaaugucuacacuc

SEQ ID NO: 1113 - RNA, 19 nt, Artificial Sequence
  Description of Artificial Sequence: Synthetic oligonucleotide
ucguacucuguacaauucc

SEQ ID NO: 1114 - RNA, 19 nt, Artificial Sequence
  Description of Artificial Sequence: Synthetic oligonucleotide
ucguacucuguacaauucc

SEQ ID NO: 1115 - RNA, 19 nt, Artificial Sequence
  Description of Artificial Sequence: Synthetic oligonucleotide
uuuagguccuucauuaguc

SEQ ID NO: 1116 - RNA, 19 nt, Artificial Sequence
  Description of Artificial Sequence: Synthetic oligonucleotide
ugagugaaugugaugguuc

SEQ ID NO: 1117 - RNA, 19 nt, Artificial Sequence
  Description of Artificial Sequence: Synthetic oligonucleotide
uaaaugccaaugucuacac

SEQ ID NO: 1118 - RNA, 19 nt, Artificial Sequence
  Description of Artificial Sequence: Synthetic oligonucleotide
agaagagccucuaacugag

SEQ ID NO: 1119 - RNA, 19 nt, Artificial Sequence
  Description of Artificial Sequence: Synthetic oligonucleotide
aauaagucccagcaucauc

SEQ ID NO: 1120 - RNA, 19 nt, Artificial Sequence
  Description of Artificial Sequence: Synthetic oligonucleotide
aagagccucuaacugagag

SEQ ID NO: 1121 - RNA, 19 nt, Artificial Sequence
  Description of Artificial Sequence: Synthetic oligonucleotide
uuguacauaaaugccaaug

SEQ ID NO: 1122 - RNA, 19 nt, Artificial Sequence
  Description of Artificial Sequence: Synthetic oligonucleotide
uaaaucuuggaagaccugc

SEQ ID NO: 1123 - RNA, 19 nt, Artificial Sequence
  Description of Artificial Sequence: Synthetic oligonucleotide
aacacgaguuucaucuagg

SEQ ID NO: 1124 - RNA, 19 nt, Artificial Sequence
  Description of Artificial Sequence: Synthetic oligonucleotide
agcuuacaaacagcaaugc

SEQ ID NO: 1125 - RNA, 19 nt, Artificial Sequence
  Description of Artificial Sequence: Synthetic oligonucleotide
uguguuuggaaugcaccac

SEQ ID NO: 1126 - RNA, 19 nt, Artificial Sequence
  Description of Artificial Sequence: Synthetic oligonucleotide
auuucaccagacccaaaac

SEQ ID NO: 1127 - RNA, 19 nt, Artificial Sequence
  Description of Artificial Sequence: Synthetic oligonucleotide
augggcacuaaucacaggc

SEQ ID NO: 1128 - RNA, 19 nt, Artificial Sequence
  Description of Artificial Sequence: Synthetic oligonucleotide
auaagucccagcaucaucc

SEQ ID NO: 1129 - RNA, 19 nt, Artificial Sequence
  Description of Artificial Sequence: Synthetic oligonucleotide
agccaugcuuauuuugagc

SEQ ID NO: 1130 - RNA, 19 nt, Artificial Sequence
  Description of Artificial Sequence: Synthetic oligonucleotide
auuguaggccaccacucgg

SEQ ID NO: 1131 - RNA, 19 nt, Artificial Sequence
  Description of Artificial Sequence: Synthetic oligonucleotide
augccaaugucuacacucc

SEQ ID NO: 1132 - RNA, 19 nt, Artificial Sequence
  Description of Artificial Sequence: Synthetic oligonucleotide
uuagguccuucauuagucc

SEQ ID NO: 1133 - RNA, 19 nt, Artificial Sequence
  Description of Artificial Sequence: Synthetic oligonucleotide
auggugaggguuaucgagg

SEQ ID NO: 1134 - RNA, 19 nt, Artificial Sequence
  Description of Artificial Sequence: Synthetic oligonucleotide
auguucgaacagcaacauc

SEQ ID NO: 1135 - RNA, 19 nt, Artificial Sequence
  Description of Artificial Sequence: Synthetic oligonucleotide
aucugauuucaccagaccc

SEQ ID NO: 1136 - RNA, 19 nt, Artificial Sequence
  Description of Artificial Sequence: Synthetic oligonucleotide
agaagcgaggcugcuggag

SEQ ID NO: 1137 - RNA, 19 nt, Artificial Sequence
  Description of Artificial Sequence: Synthetic oligonucleotide
aggacagauucugaggagc

SEQ ID NO: 1138 - RNA, 19 nt, Artificial Sequence
  Description of Artificial Sequence: Synthetic oligonucleotide
uuaucgagggaauggaugg

SEQ ID NO: 1139 - RNA, 19 nt, Artificial Sequence
  Description of Artificial Sequence: Synthetic oligonucleotide
agaccuucaaucagcugag

SEQ ID NO: 1140 - RNA, 19 nt, Artificial Sequence
  Description of Artificial Sequence: Synthetic oligonucleotide
auggaugugccaaugggcc

SEQ ID NO: 1141 - RNA, 19 nt, Artificial Sequence
  Description of Artificial Sequence: Synthetic oligonucleotide
ugugccaaugggccauggg

SEQ ID NO: 1142 - RNA, 19 nt, Artificial Sequence
  Description of Artificial Sequence: Synthetic oligonucleotide
uguggcaguauccagguac

SEQ ID NO: 1143 - RNA, 19 nt, Artificial Sequence
  Description of Artificial Sequence: Synthetic oligonucleotide
acuucacaauucagaauug

SEQ ID NO: 1144 - RNA, 19 nt, Artificial Sequence
  Description of Artificial Sequence: Synthetic oligonucleotide
ucauuaguccuuccaggug

SEQ ID NO: 1145 - RNA, 19 nt, Artificial Sequence
  Description of Artificial Sequence: Synthetic oligonucleotide
acuucacaguuggaguugg

SEQ ID NO: 1146 - RNA, 19 nt, Artificial Sequence
  Description of Artificial Sequence: Synthetic oligonucleotide
auaggaggccggcuccuuc

SEQ ID NO: 1147 - RNA, 19 nt, Artificial Sequence
  Description of Artificial Sequence: Synthetic oligonucleotide
acaauuccuuguuuucaag

SEQ ID NO: 1148 - RNA, 19 nt, Artificial Sequence
  Description of Artificial Sequence: Synthetic oligonucleotide
agcucaucugguucauagc

SEQ ID NO: 1149 - RNA, 19 nt, Artificial Sequence
  Description of Artificial Sequence: Synthetic oligonucleotide
aauaacccagucauguauc

SEQ ID NO: 1150 - RNA, 19 nt, Artificial Sequence
  Description of Artificial Sequence: Synthetic oligonucleotide
agcuacucucggagucuuc

SEQ ID NO: 1151 - RNA, 19 nt, Artificial Sequence
  Description of Artificial Sequence: Synthetic oligonucleotide
accauguuuauuguaggcc

SEQ ID NO: 1152 - RNA, 19 nt, Artificial Sequence
  Description of Artificial Sequence: Synthetic oligonucleotide
aggccaaacaaguguguac

SEQ ID NO: 1153 - RNA, 19 nt, Artificial Sequence
  Description of Artificial Sequence: Synthetic oligonucleotide
acuacagaaaaggccaaac

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
cuccgagaguagcuaugaatt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
gcucuucuguuauauuaaatt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
gaguguagacauuggcauutt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
ggaauuguacagaguacgatt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
ggaauuguacagaguacgatt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
gacuaaugaaggaccuaaatt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
gaaccaucacauucacucatt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
guguagacauuggcauuuatt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
cucaguuagaggcucuucutt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
gaugaugcugggacuuauutt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
cucucaguuagaggcucuutt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
cauuggcauuuauguacaatt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
gcaggucuuccaagauuuatt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
ccuagaugaaacucguguutt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
gcauugcuguuuguaagcutt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
guggugcauuccaaacacatt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
guuuugggucuggugaaautt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
gccugugauuagugcccautt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
ggaugaugcugggacuuautt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
gcucaaaauaagcauggcutt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
ccgagugguggccuacaautt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
ggaguguagacauuggcautt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
ggacuaaugaaggaccuaatt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
ccucgauaacccucaccautt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
gauguugcuguucgaacautt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
gggucuggugaaaucagautt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
cuccagcagccucgcuucutt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
gcuccucagaaucuguccutt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
ccauccauucccucgauaatt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
cucagcugauugaaggucutt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
ggcccauuggcacauccautt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
cccauggcccauuggcacatt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
guaccuggauacugccacatt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
caauucugaauugugaagutt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
caccuggaaggacuaaugatt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
ccaacuccaacugugaagutt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
gaaggagccggccuccuautt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
cuugaaaacaaggaauugutt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
gcuaugaaccagaugagcutt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
gauacaugacuggguuauutt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
gaagacuccgagaguagcutt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
ggccuacaauaaacauggutt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
guacacacuuguuuggccutt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
guuuggccuuuucuguagutt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
uucauagcuacucucggagtt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
uuuaauauaacagaagagctt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
aaugccaaugucuacacuctt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
ucguacucuguacaauucctt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
ucguacucuguacaauucctt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
uuuagguccuucauuaguctt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
ugagugaaugugaugguuctt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
uaaaugccaaugucuacactt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
agaagagccucuaacugagtt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
aauaagucccagcaucauctt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
aagagccucuaacugagagtt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
uuguacauaaaugccaaugtt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
uaaaucuuggaagaccugctt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
aacacgaguuucaucuaggtt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
agcuuacaaacagcaaugctt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
uguguuuggaaugcaccactt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
auuucaccagacccaaaactt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
augggcacuaaucacaggctt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
auaagucccagcaucaucctt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
agccaugcuuauuuugagctt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
auuguaggccaccacucggtt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
augccaaugucuacacucctt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
uuagguccuucauuagucctt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
auggugaggguuaucgaggtt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
auguucgaacagcaacauctt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
aucugauuucaccagaccctt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
agaagcgaggcugcuggagtt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
aggacagauucugaggagctt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
uuaucgagggaauggauggtt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
agaccuucaaucagcugagtt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
auggaugugccaaugggcctt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
ugugccaaugggccaugggtt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
uguggcaguauccagguactt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
acuucacaauucagaauugtt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
ucauuaguccuuccaggugtt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
acuucacaguuggaguuggtt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
auaggaggccggcuccuuctt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
acaauuccuuguuuucaagtt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
agcucaucugguucauagctt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
aauaacccagucauguauctt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
agcuacucucggagucuuctt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
accauguuuauuguaggcctt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
aggccaaacaaguguguactt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
acuacagaaaaggccaaactt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
gcagaauuccgcaucuacatt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
gaauaugguuguaagagcutt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
cucuucaugcuggaucugutt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
gaguucaaguucaacuuautt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
cgugaguaguuguuggucutt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
ggacgaccaugagagauaatt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
ccuagauuacaucugccuutt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
caacagagucguaaucgcutt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
gucuaucaaagguagauuutt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
cccggacgaccaugagagatt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
cucgucagcgacaccacaatt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
ccacuaacucgaaaccagatt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
guaaaugacgugaguaguutt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
ggggacacacauucugccutt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
cggcugcagaauuccgcautt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
gccgacaacagagucguaatt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
ggaugccacuaacucgaaatt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
ccgacaacagagucguaautt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
cgugcugugcgccaacuaatt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
caacgcacacaugaaugcatt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
cugucuaucaaagguagautt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
gcgggucuccagugcuucatt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
cugaguuuggaugucuguatt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
caggaagcaugagcuguautt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
ggcuggcuggaauuugacatt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
gcagaccuugguucaccuutt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
gacgugaguaguuguuggutt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
cagagucguaaucgcucuatt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
cagaccuugguucaccuuatt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
gggucuccagugcuucagatt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
gcacacaugaaugcaaccatt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
gguaaaugacgugaguagutt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
cacacaugaaugcaaccaatt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
cgacaccacaaagaguucatt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
cucauuaauaauuugcucatt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
cauuaauaauuugcucacutt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
guacugucuaucaaagguatt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
cuuguggaugccacuaacutt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
guucaguacugucuaucaatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
cuuggauuccuagauuacatt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
ggucuguagcaagcugagutt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
gauuuuaaaggaccucauutt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
caaacuuuucuuaucagcatt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
guggaugccacuaacucgatt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
gucagcgacaccacaaagatt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
ucaugagcuuugugaaccutt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
gagacggcccuuacgacaatt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
acggcccuuacgacaagcatt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
aaccugguggaguacgacatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
gcagagacggcccuuacgatt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
accugguggaguacgacaatt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
agagacggcccuuacgacatt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
ucccacucaacgcacacautt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
ucaacgacgcggacauggutt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
gccaucucgguucuuuacutt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
aaugccaucucgguucuuutt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
aacgacgcggacauggucatt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
augccaucucgguucuuuatt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
uguagaugcggaauucugctt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
agcucuuacaaccauauuctt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
acagauccagcaugaagagtt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
auaaguugaacuugaacuctt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
agaccaacaacuacucacgtt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
uuaucucucauggucgucctt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
aaggcagauguaaucuaggtt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
agcgauuacgacucuguugtt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
aaaucuaccuuugauagactt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
ucucucauggucguccgggtt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uuguggugucgcugacgagtt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
ucugguuucgaguuaguggtt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
aacuacucacgucauuuactt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
aggcagaaugugugucccctt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
augcggaauucugcagccgtt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
uuacgacucuguugucggctt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
uuucgaguuaguggcaucctt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
auuacgacucuguugucggtt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
uuaguuggcgcacagcacgtt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
ugcauucaugugugcguugtt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
aucuaccuuugauagacagtt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
ugaagcacuggagacccgctt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
uacagacauccaaacucagtt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
auacagcucaugcuuccugtt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
ugucaaauuccagccagcctt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
aaggugaaccaaggucugctt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
accaacaacuacucacguctt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
uagagcgauuacgacucugtt

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
uaaggugaaccaaggucugtt

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
ucugaagcacuggagaccctt

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
ugguugcauucaugugugctt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
acuacucacgucauuuacctt

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
uugguugcauucaugugugtt

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
ugaacucuuuguggugucgtt

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
ugagcaaauuauuaaugagtt

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
agugagcaaauuauuaaugtt

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
uaccuuugauagacaguactt

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
aguuaguggcauccacaagtt

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
uugauagacaguacugaactt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
uguaaucuaggaauccaagtt

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
acucagcuugcuacagacctt

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
aaugagguccuuuaaaauctt

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
ugcugauaagaaaaguuugtt

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
ucgaguuaguggcauccactt

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
ucuuuguggugucgcugactt

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
agguucacaaagcucaugatt

SEQ ID NO: 1346 - DNA, 21 bp, Artificial Sequence
  Description of Artificial Sequence: Synthetic oligonucleotide
  Description of Combined DNA/RNA Molecule: Synthetic oligonucleotide
uugucguaagggccgucuctt

SEQ ID NO: 1347 - DNA, 21 bp, Artificial Sequence
  Description of Artificial Sequence: Synthetic oligonucleotide
  Description of Combined DNA/RNA Molecule: Synthetic oligonucleotide
ugcuugucguaagggccgutt

SEQ ID NO: 1348 - DNA, 21 bp, Artificial Sequence
  Description of Artificial Sequence: Synthetic oligonucleotide
  Description of Combined DNA/RNA Molecule: Synthetic oligonucleotide
ugucguacuccaccagguutt

SEQ ID NO: 1349 - DNA, 21 bp, Artificial Sequence
  Description of Artificial Sequence: Synthetic oligonucleotide
  Description of Combined DNA/RNA Molecule: Synthetic oligonucleotide
ucguaagggccgucucugctt

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
uugucguacuccaccaggutt

SEQ ID NO: 1351 - DNA, 21 bp, Artificial Sequence
  Description of Artificial Sequence: Synthetic oligonucleotide
  Description of Combined DNA/RNA Molecule: Synthetic oligonucleotide
ugucguaagggccgucucutt

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
augugugcguugagugggatt

SEQ ID NO: 1353 - DNA, 21 bp, Artificial Sequence
  Description of Artificial Sequence: Synthetic oligonucleotide
  Description of Combined DNA/RNA Molecule: Synthetic oligonucleotide
accauguccgcgucguugatt

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
aguaaagaaccgagauggctt

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
aaagaaccgagauggcauutt

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
ugaccauguccgcgucguutt

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
uaaagaaccgagauggcautt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
aauaaggaagggaggggactt

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
aaauaaggaagggaggggatt

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
uaaauaaggaagggaggggtt

SEQ ID NO: 1361 - DNA, 21 bp, Artificial Sequence
  Description of Artificial Sequence: Synthetic oligonucleotide
  Description of Combined DNA/RNA Molecule: Synthetic oligonucleotide
auaaauaaggaagggagggtt

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
aauaaauaaggaagggaggtt

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
uaauaaauaaggaagggagtt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
aaauaaauaaggaagggagtt

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
aggaauaaauaaggaagggtt

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
uaggaauaaauaaggaaggtt

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
aaggaauaaauaaggaaggtt

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
acaggaauaaauaaggaagtt

SEQ ID NO: 1369 - DNA, 21 bp, Artificial Sequence
  Description of Artificial Sequence: Synthetic oligonucleotide
  Description of Combined DNA/RNA Molecule: Synthetic oligonucleotide
ucaggaauaaauaaggaagtt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
agcaggaauaaauaaggaatt

SEQ ID NO: 1371 - DNA, 21 bp, Artificial Sequence
  Description of Artificial Sequence: Synthetic oligonucleotide
  Description of Combined DNA/RNA Molecule: Synthetic oligonucleotide
aagcaggaauaaauaaggatt

SEQ ID NO: 1372 - DNA, 21 bp, Artificial Sequence
  Description of Artificial Sequence: Synthetic oligonucleotide
  Description of Combined DNA/RNA Molecule: Synthetic oligonucleotide
uagcaggaauaaauaaggatt

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
acagcaggaauaaauaaggtt

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
ucagcaggaauaaauaaggtt

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
uggggcagcaggaauaaautt

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
ucuggggcagcaggaauaatt

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
uucuggggcagcaggaauatt

The invention claimed is:

1. A double-stranded ribonucleic acid (dsRNA) compound, comprising a sense strand and an antisense strand that are each equal to or less than 30 nucleotides in length, wherein the compound is targeted to a nucleic acid molecule encoding transferrin receptor 2(TRF2), wherein the compound specifically hybridizes with the nucleic acid molecule so that the abundance of TRF2 mRNA is inhibited by at least 20% relative to a PBS control, and wherein the antisense strand comprises at least 15 contiguous nucleotides from the nucleotide sequence of SEQ ID NO:38.

2. The dsRNA of claim 1, wherein the nucleotide sequence of the sense strand comprises 15 or more contiguous nucleotides of SEQ ID NO:35 with a start position of position 239 of the TFR2 mRNA transcript and the nucleotide sequence of the antisense strand comprises 15 or more contiguous nucleotides of SEQ ID NO:38 with a start position complementary to position 239 of the TFR2 mRNA transcript.

3. The dsRNA of claim 1, wherein the nucleotide sequence of the sense strand comprises 16, 17, 18, 19, 20, or 21 contiguous nucleotides of SEQ ID NO:35 with a start position of position 239 of the TFR2 mRNA transcript and the nucleotide sequence of the antisense strand comprises 16, 17, 18, 19, 20, or 21 contiguous nucleotides of SEQ ID NO:38 with a start position complementary to position 239 of the TFR2 mRNA transcript.

4. The dsRNA of claim 1, wherein the sense strand comprises the nucleotide sequence set forth in SEQ ID NO:35 and the antisense strand comprises the nucleotide sequence set forth in SEQ ID NO:38.

5. The dsRNA of claim 1, further comprising a phosphorothioate at the first internucleotide linkage at the 3' end of the sense strand, the antisense strand or both the sense strand and the antisense strand.

6. The dsRNA of claim 1, wherein the sense strand, the antisense strand or both the sense and antisense strand further comprises at least one 3'n-overhang wherein the 3'-overhang comprises from 1 to 6 nucleotides.

7. The dsRNA of claim 1, wherein the dsRNA further comprises a non-nucleotide moiety.

8. The dsRNA of claim 1, wherein said dsRNA further comprises at least one modified nucleotide.

9. The dsRNA of claim 1, further comprising a 2'-modified nucleotide in the sense strand, r the antisense strand or both the sense and antisense strand.

10. The dsRNA of claim 8, wherein at least one of said modified nucleotides is selected from the group consisting of: a 2'-O-methyl modified nucleotide, a nucleotide comprising a 5'-phosphorothioate group, and a terminal nucleotide linked to a cholesteryl derivative or dodecanoic acid bisdecylamide group.

11. The dsRNA of claim 8, wherein the modified nucleotide is selected from the group consisting of: a 2'-deoxy-2'-fluoro modified nucleotide, a 2'-deoxy-modified nucleotide, a locked nucleotide, an abasic nucleotide, 2'-amino-modified nucleotide, 2'-alkyl-modified nucleotide, morpholino nucleotide, a phosphoramidate, and a non-natural base comprising nucleotide.

12. The dsRNA of claim 1, wherein the dsRNA is formulated in a nucleic acid lipid particle formulation.

13. The dsRNA of claim 1, wherein the nucleic acid lipid particle formulation comprises a cationic lipid, a non-cationic lipid, and a cholesterol/ polyethyleneglycol-lipid conjugate.

14. The dsRNA of claim 1, wherein the dsRNA is selected from the group consisting of AD-52551, AD-52552, AD-52557, AD-52558, AD-52563, AD-52564, AD-52569, AD-52570, AD-52574, AD-52575, AD-52579, AD-52580, AD-52584, AD-52585, AD-52589, AD-52590, and AD-47826.

15. A cell comprising the dsRNA of claim 1.

16. A vector encoding at least one of the antisense strand and the sense strand of the dsRNA of claim 1.

17. A cell comprising the vector of claim 15.

18. A pharmaceutical composition comprising the dsRNA of claim 1 and a pharmaceutically acceptable carrier.

19. The pharmaceutical composition of claim 17 further comprising a lipid formulation.

20. A method of inhibiting TFR2 expression in a cell, the method comprising:
(a) introducing into the cell the dsRNA of claim 1 and
(b) maintaining the cell produced in step (a) for a time sufficient to obtain degradation of the mRNA transcript of a TFR2 gene, thereby inhibiting expression of the TFR2 gene in the cell.

21. A method of treating a disorder associated with TFR2 expression comprising administering to a subject in need of such treatment a therapeutically effective amount of the dsRNA of claim 1.

22. The dsRNA of claim 1, wherein the sense strand consists of the nucleotide sequence set forth in SEQ ID NO:35 and the antisense strand consists of the nucleotide sequence set forth in SEQ ID NO:38.

* * * * *